United States Patent 10,233,495 (METHODS AND COMPOSITIONS FOR SCREENING AND TREATING DEVELOPMENTAL DISORDERS) - sequence listing, part 175

SEQ ID NO: 1095 - DNA, 4745343 bp, Homo sapiens (residues 3,163,563-4,745,343 of 4,745,343)
  misc_feature (38159)..(88158): n is a, c, g, or t
  misc_feature (258828)..(308827): n is a, c, g, or t
  misc_feature (347139)..(447138): n is a, c, g, or t
  misc_feature (1469533)..(1519532): n is a, c, g, or t
  misc_feature (1801065)..(1851064): n is a, c, g, or t
  misc_feature (3417720)..(3467719): n is a, c, g, or t
  misc_feature (3653040)..(3703039): n is a, c, g, or t
  misc_feature (3875829)..(3925828): n is a, c, g, or t
  misc_feature (4146142)..(4196141): n is a, c, g, or t
  misc_feature (4651327)..(4701326): n is a, c, g, or t
actataaagtatgctgagatcttcttacctggtaattaaaacaacaaggacaacaacaacaacaacaacaacaacaacaacaacaaaccaatcaacccaagtatgctagatgggtaaaagacttgaacagatacataagaataaaaggtacacacatggtcaacaaagcatatacaatatgtttagctctcaggaaaatggaaatcaaaaccacattgagacaccactataactcccagtagcatggctaaatttataaggagaggaaacacccaatcttggagaagatgaagaacaaccacaactctcacacgtcattgctggaaatgtaaaatgacacaactactttgggccaagttttgtgagtttttatgatcttgcacatatctcactctttggtaccagcaattaggcaactaggttttccccaagagacacgaaaacaggtgccctcaaaatctcttgtgggaagaaagttcaaagccggcttattcagaatacccaataccggtttattcagaatagccaatacccagacgctcattatcggggtggaggtggggcgagaatggcaaacaaactgtgctgtctctttgcaatggaatactactcagcaatgaaagaggaatgaacttctgctacactcagcaatggatagagccagagacattatgcagagagaaagaagcatgtagaacagagtagatgcaaggtgattccatctgcgtgaagttctacaagcaaaggtaaagtgaaaacaatctggagagtgattgttcacaaataaggcagaggacaatgataatgatttttataattctagtgattacgttattgattgagtagtcactaaatccaggcccgtctgacaacagcagtgtaaggcagagttcccaaagaggcccaaccttccacagaaaaatgttgaggcacataaaatttaagatagttaaccaaggtcaggcaagggctgacatagatttctaatacagaacctgggttcttggacatagattagactggacctgtccacttctctgtttcagatgtctctgggattctcagctgcatcagaggagagacagaaggacagagaaggagacagagggagagaggagtagggaagaaatggagggaggcacagggcccatagctgtgaaacagcagagaagtaactcttgccagtgtatttacagtatacagaagttttctggtgatcaggacattagcagatgctaagtttgctgtggtcaggagatgaatttgatatgccatagatttagaaattaaaacgaaaccctaaagttattggaagagaatgtagcagaatacatttctgccttaagagataacaggaaaaaataaagcaaagtagaatttcaccaaagttatcaacttctgctcatcaagaatcaccatgagaaagtgagaaggtgagccacagactgggagaagataattgcactgtgtttacctgaaaaaaaaaaaggctcaaattttgaatatagagagtactttttacaaatcagtaataaaaagcaaagccaattgaattagggaaaatgcttcaaagcctgtcttctcaaagaaggattgctaaacggtgaaaaggcattagaaaatatgctcaacagcattactcattaaaggaaacacaaattgaagccacgatgtggtaccgttttacatccaccagaacaggtgtatttaaaaaacagtaaacaccacgcgctgtcaaggatgttcagccagtggaactctccttgctggtgagaaagcattctggaagaaaccatttggccgtttctaataaagttaatattacacctaccctatgatccaacaattccagtacttggtattcctcaagggaaatgaatgcacgtgtccacaaaaagacctatacaagaagaattttcgttcatcttgtccagcaagtggcatcggtttcctatcagcaggagtctgaacacttctggccctagcctcttggtatcagagtcgccaaggaaatacaaggcagtcagagactggacgggagaacaacacattattcatacagagaggagacagagcggggtgtgggctccgcttcagtcttgggcgttggtcccccatggccagcaggtccctccatttggcctgcacacacagcctcttgagaagcagaagaaaggacccccgcttcctcccctcagtggggggcagatacagcagctggccaggtgccagttgatgcacatgcttaagtggaacaaaggggtacacaccaagtctgatcgggggaaagatactcccacacaaggaggtgagtccagcacaggctgtgatgactccttatctctcaggaaggaagtgctccaggcccaaggcccattcctacgtggcagagtggaggtggaaagacccctggcaccagattgcctttcctcacactttgctgttggcatacaaacttggtgacgggcacagagacaagccattgtaggccacaacaaagagtttggagtttaaagtcattaaaagcttcttgtcgtttcgtgtgtaacagccccagtgactggaaaacaggtcctgagcacaccattgccttcgtgtaagccaccaccaacagggctgactgggttatttgctctgtgaggctcagagacaggacggtgcacgtccagagtttcccttggactcctccccaggtgagtgagctgtgaggtctcttttccttaccccgacgtgcccccagtgaccagaagaacggttctgagcacaccattgccttcgtgtaagccaccaacagggccgactgggttatttgctgcgtgaggctcagaaacaggagggagcacgtccagggtttcccttggattcctcgccaagttagtaaggtgtgaggtctcttttccttcccctgacgcgcctggttgcgggagcaaaagggaagagctgacagcctagactaacgacattgccgtgactcggattcgaaccgaggttgctgcggccacaacgcagagtactaaccactatacgatcacggcgagccacaggctaagccgcgatggcggagcttgctctagcccttttgacgtcaatggatttcgattattaggcggattcgttcccagacagccacaggggactcgcgcttttctttcatgcccgctctgcttttccctcccttcctcccaatcttcatacgtgatgagaacaattctcatctcctccactccagcctgggcctccctgcaccagcctctctcgggaggtctctctgtcctggtccgcacctcctctgcttctgtggggcctctccgtatttctgcttttcacccctcctctctcccgccccaccgaccgaggccgaggtgagcgaggggagcgcaagcagcagtagagaatcgggtgaaggcggagccaagaaggggaagagccatcactagagcccacggggcgttctgcttgcttcccctgggacccacgcggctcaggcccagggagtcgcggacccgggcgtttcctgggatgctgggtctgacgcctgcgagggtcaggacggggcgaaggccattccgctgcccttccagcttcggaatcacccaatgcacggcaagatgtgccggcaagatgtgcctctcaggttttccgaggctttggagcctgcacaattgttctacaaaaggcagtagctccgccgaacgttggatcgtcccttggtctggtgataccagaacgagagttgactgtgtgtctcagtcggttggtatgcttgcttccaagcctggaggtgggtggttcgagcctgttctatagagctatttcttgcattttaaaaatgcttaaaccgctggcaactttcttctatcgagcacatggtttcatggaaaggcagagcgagaccaactttaccctccactcctccttgtctcgcgtaggacaagaggaagtaaatcaaggtccactaggattctgggaactctctctcacctttttttttttttttttttgagaccgggtctccctctgttgcatagctggagttccctggcgcgatctcgcctcactgcaacctccgaccctctggttcaagcaattctcctgcctcagccccccgagtagctgggattataggcatgggccaccacgcccagttaagttttatatttttagtagagaccgggtttcaccatgttggccagggtggtctcggtctcctgacctcgtgacccgcccgcctcagcctcccaaagtgctgggattacaggagtgagccaccgcgcctggcgccctctctctctctctctttctctgtctctctaactgtcattcatttagccctttccatacgcttttgaggttaaattggttctgtgattttacaattacatataatgctctagtcattcttgtacgggcattgtcatccactggtgtataagtatttctataggatagaggtgcaattactatagaaagagcaattactctatcatagtgtccacgctgtttttatatcattccattctctctcctcttttggcttattagctataactctttcatttgttattttagtaattgccttagggcttatagccaacctttttaacttatcacagtcaaccttcaagtgatgttatacctcgccttctggccttgatgctattgctgacatgcactttacctttgggcatgttataaaccccacaacccattgttgcttttgtttaaatggtcaaattttcacaaaagaaatttacaaaataagaaaatacctattatagttacccatttctggtgttcttcatttcctctggaaatgaagatctggatttttgtctggtattgggttccttctgcctggaggactcctttcacggtttttgtagtgtggctcagctggctgctagtgaattcggtcagcttttgtacatctctaaatgtcatttttttttttttttttttttttttttttgagatggagtctcgctctgtcgcccaggctggagtgcagtggggcgatctcggctcactgcaaactccacctcccaggttcacaccattctcctgcctcagcctccccagtagctgggattacaggcacccgccaccatgcccggctatttttttgtatttttagtagaggcggggtttcaccgtgttagccaggatagtctcaatctcctgaccttgtgatccacccacctcggcctccctaagtgctggggattacaggcttgagccaccgtgcctggcctaaatgtccttatttcacttccagttttgggaatttattttttctggcatagtattctaggttaacttcccctgccctcagtaccttaaagatgttgcttctctgtctgctcgtgtgcattgctgctcctggtagaggccggcaagagcagaaaggaagctgatgcaatcctcatctttgctcctgtgtatgtacaatgtctttttcttctggccagatttgagcaatgttattatgaggtatctaggagtggttttcttcatgtttcttgtgcttttgtttcctcagttccttgggtcactggatttataatttttgttatgattgggaactttccagctatttttcttcagaaattggctgggcacagtggctcacgcctttgggaggccaagtcgggaggtgttgagtgaggcctgaaattcaagaccagcctgggtctcaacatactgagaccccattcctaataaaaataacaaagaaagaaaataaatgtttcctttcctccctgctccttctcagggactcccattactcataaattagacctcttaagtctgccctacagttcagtgataatcttttcatttaaaaaaatttcttttttctgtaagtttcattttgcatattttcaattattcatggttccatgttccctgatcatttcttctgcaacatctaatctgctgttaatcccatccaacgactttaccatctctgatagtgtggttttggcatgatatcggctcactgcaacctctgcctgcctggctcaagtgattctcctgcttcagcctcccaagtagttggtactataggcatgtgccacgatacccggccaatgttttgtattttgagtagagacaggggtttcaccatgttagccaggatcatcttcatctcctgactttgtgatctgccggattcagactcccaaagtcctaggattacagttgtgagccagtgcacctggccccttccttccttccttccttcctcccttccttccttccttccttccttcctttcatgagacagggtctcaccctgtagcccaagctggacttcagtgatgtaatcttggctcactgcaacctctgcctctcagggtgaaacgatcgtcccactgcaacctcctgactagctgggactacaggcacacaccaccatgcctggctaattatttgaaatttttttggtagagatgaggtttcatcatgttgcccagtctggtctgaaactcctgagctcaagggatcagcccaccccggcctcccaaactgctggcattacaggcacctgtttgtttgtggagaggagcagtggggagatttcaggcaggagagtaaatcaggcatctgttactcaaactttgctgggagctgaaggcatctgtttacgtgttcttagtttgacttcaacaggaggtgtgccaatttatcttccaacatatttttccaactcagtgagacagccttttccttcgtgctcttggcagctcagcaaagtttccatacaccagtctgatgtaccagtgacggggtggtgccctgcctgacttacctaagcaggaggcgcagcagaaagacatggtggacactgcccagagatactctctgataagtgttccacagctaaacctccaagatgtttagaaagtcttccaataattgtaattgttttctctggtgatctacctaactaagtccagagaaaactggctggagggaccctgagctgcttcctgtcaagaggcttatcaaataggaggggaaagaatggcttcttctagaaatttgttcctcttctcatttctttatgaattgcattctgcttttgttgaatgcaaacgatctatggactgttctccctcctagacaagggtgaattagcatgctaaaaactacctctgtgttattccttccttgacagtgtttgttttgttttgattttttgtaagactcatctcactggagacaaatctctggagccataggatcctgcacctgaccatgcttcttatgcagacctggatccttggagttattggccccctttgccttggttcttttgttgactctcttcagcaaaactgaactccaacttttacaccctaaatctggctcttggacatataggtccttttgcttcccaactcctccttgatccagccctgcctttccaacctctccatctgtgtctgtgtgcctgtgtcttgtctgtctgtctctcatactccaggctgcccccagtattacccactttcttctcctcctcttcaatgttcagggttcagcttcctctctacctacagagtcccacagactgaaggtgtttccccttacagagaggggagctcattccagaaggtgccctctagacttggaataaaccttacaaagaacacccaggtttgaaaagctttttctatcttcccattaccccaattattcaaaggactaaaagtgggaagtccagtagaattcttgatgtctctcagaaaccgacattggaatgccttcattcactgagcatatattgggtgctcactaggtgtgaatcctttctctaggtgagtagctgcatggtgtgccaatcctgccttacagagcccacatctagaggcctcaagaagagactgggcagtgggaacacaaccggcttgtgtcctccccacgagcgtttccccgttcagggacaggggacacgagcagtgagcatgacaaatgaagcacagtgaaggaaggggaagtgggtgacttcagaccaagaggctactgtggtcatgtgcagtggggccgcttctgataggggaagcgcaagaggcagtgtgggccagggagaatgtcctggatctggcattcctgcatcttgcccccactcacactgcctggtaacaatgtacccaaccacacaacttctggcctccatgtcactacgccctcaggcatctagatgcgcagcctggggatgggggcatttaataatagacagatgtctgaggcagatgtcgtcagacttccaggcacaacgtgcctcattgtggagcaattagggcagtcatcggcaaaaaactaaagactactcatcctgttccatgcaggagcatagttaaccttgtaactattcttttctgaccttcattcttccacgtccagatatatggggtctttgatgcccatctgcttcaagttagatgatgaaaatcctgcctgaaggcttaggggtttgttagaaaaataaatgctgttcgcaaaaggtgcattttaggcaaaagctcagttctggagctccagaatctacctaccccaagcccaatatacacctcctttctgtacctccatcctcgttgcacctgccttcgctgattcttcaggctgcccatctctgagaagatggcaatccctagcagaagaacaagagaaccttggacacttctgtccatgaagccgtagacgcgagcagatagccttattccttggcggtgtgactctgaagtcacaggttttctgtgcctccatttctgcattctaaaatgggcccaataggaatgcgtttctaaatgggttgttccaagtttaaataagacagggcagtaaaacattgaacccatgccctgaggcatagtaaatgctccaagagcattaaccattatcatcggtggcctcatcacggctattattatctacatccatctttgaaataattgcatatccttttagggtatggagtgatcacaacatataacatttcctaattggtgaacatttattattacaatattgctgttctttattacaaatattgctgctgggaacatatttctgcattttaatcatcacctgtgtgtttctctatcaaatcttcacacacaatttggggatgttacaaaatgtattccttcatcgggaattgaacccgggccgcacaggtgaaagcaccgaatcctagccactagaccaccaaggaagctgacccacacaaccatctccttttcagaggaaaaaagagaaggtaaagaaagatgaactttctaagagatggagcggccaactgaaagtggctgtctgtgacccaagcgggctgcaggactgcagggctccaggcagtcactgagcagctactcaacacctctcgcctctgccagcctggccgctgctttgggctgtattgaggacaggccacaaggaaactgagcaggtgttccattctagcctagctgtagcaaggtgtgaggcagagccaagcacttgctctgtttccgagcctcagtttccttgccaccgaagtgcggacttggctctcattgtgagccgaatccctctgcttcctgatctctgaactggcgcaaggggctctaccaataaagacatgtgtaggggtccccttttgcccccaactagctcaattagtagagcatgaaactgaatggatgggtctttggctcgagctccaggtgcagatttacgttcattttcttttgttccgccacacaattcgaccggttccgccactgtcctcggggcgcgaggaagccaagtgggcttcacaggaaagacctccttggtttcagagacattgtagctgtcatcttgaaatcttcagaaagaagattttggcgatagatgagaagactggaaatttctggatctaaagctaacatgaagtccacctcatctggcgcccttgtctcccgatccaactcacggatccaactcatggcgggcaaaccaggcctggttccttgtgctcagcggggtttcaggtagtaatggaactcctcccgtacttcttgtgatcaaagatgcagctagtttcccccatcccacccctcagctcccctcccctcccttaaaaaaacagaaaaagaaaaggtcattatgaaagccacctttcgtgtgagaggcgaacctgctgaccccactctagctaaacgacccgagcaccgccccttgaggacaaacccacgaaaatgttaggcgccgccttgggcaactgcgtattgctgcctgtgacagatgaaattcgactgcatctggacattcccgcggccccaggaaagtgctagcaaaaggccccggaaagcacctgcgatccctcaggtaagaagactgctgatcgcaataggcccggtctgagggttccccgcttgctcccgaaatgaagacactggagacccataaccgggctacaggatccggattcttcccgcggggtatccagttccagaactaagcgcccatgtgcgggattcgcctggctaacactctccggctcgcagaagcggcagcagccggcgggttttgagcttccgagtcccgggtgcgcaagagtgtggacgccacccctccagggctgccaagcctccagggctgccaagccgagaggctccaagccaaggggcctcatccgcgcgctctttcctcgagggccctccactcagggtgtcaacagaggtaggtcaggtgagaaacctggatttctacacacacctggcttcaacgagatggtgccactccccttcccctgcagaagcagactcagaaaaaggtagttaaaacagaaggtttcaataaaatcgagagtctggtaacataatacccaaaagtccaagtttcagttgaaaatccttcatcatagcaagaagcaggaaaatcttatgccgaatgaaaatagacagccgatacacactggcaataagatgagagaggtgttgggattgtctgacaaagattttaaagccagcaagcctgatgaaaatgatttagtaattatgagcacattcaaaacaatggacaaatagaaagccttagcaaataaatacaagacttaaaggagaaccaaatggaagtattagaggtggaaaatacaacaaccaaaataaaaagtccaacacataggctcaacagcagaatggatggtgcagagcaaagaaatccatccactacagatgaaaaaatagatattgcacaatcttaacaaggaaaaaacagactgggtgagaaggtaagcagaacctctgtgaaactacctcagaaggtctcactttcatgttgttatttatgtctggaaggggaagaggaagaggaagaggacaaggctgcaaacataaagaagtaaatggctaaaagcttcccagagttggcaagagacagaaacctacaggttcaagaagctgtgagaaccccaaatagaataaaacccaaagaggtctatggcaagccacatgaaaaaataaaatgttggaaatgaaagacaaagagaatatcttgaaagcaacacagaaaggtgacaccttacctagaaaggtaaaacaattctggggatgatcgatttctcatgagaaaccatggaggtacaatgaagttgccaggtgcttttcaagccatgaaagaaaacaattgtcaacccagactcctctctccagcagaaacatctttcagggattaaggggaagatcaaaacagtttcagattaagaaaagctaagggaatctctgaccagcagttctaccttaaaagaaaggctaaagggagttctctagacagaaaggaaatgattaaagaaggaaccttgggacatcagaaagaaaatttaaaaaaaaacaaacaaacagcaagcaaaataggccttccttcttctcttgagttttctaaactacgattgacagcttcagaaaaaaatcataccatcatttgatgtggttctaactctctgtaaaaaaaaatctttgaaataattataaactgggagggtaaagagacctacaagggaggtaactcatctatcattcattcacactggtacaacaatgacaccagtatactgtgtggtaagatagagatgcacagacatatgaatgtctggaaaaactaagagggctatgcaaacagatatactcaaaaacactatgggtaaggcaaaacaccattctgaaaaatgttcaagtcaccttaggaaggtaaggaaaagaaagcatatccagaaaacgacaccagagagaacaaacacaaaaggaaaaatataatggcagacttaagccctaccctatcaatcatcgtattaaatatcaatgatctaaatataccaattacaagacacagattggcagagtaggttaatggacgcgacacaactacatcctggctacaaagagactaccttcaaatatgatgatacaggcaagttgaaatccaaaggatgggaaaagatgtatcatgcaaaccttagacaaaggagagcaagactggttatattaatgtcagatatagtatatttcagaataaagaaactaatcagagacagagagggacaatatataatgaggaaacaaccaatccaccaactcctcccctgacaaaagtcataaatgtctatgcaacaacaattgaaattactgaacagtgaactagacaaatccacaaatatagctatatgcttcaacgtccccctttctcaacaatttatgcaataaccagacagaaaatcaacaagaatatagaagaacccaacagcatgatcaaccagtgggacttccattgacaattttagaacactcagccacaccagaatacacattgttatgggatgcattgtgcccagccaccccaaattcatatgttaaaatcagaacattagtagcaactagtgatataccaattaaaatcacaatgagaaattgctgcatacctatcagaatggccaaaagaaaagcgtaaccacatcaagtgctgtcaaggattcagagaaagctggatcactcatacattgctggtggaaatctaaatggttacagcccactctggagaatatctgtatagtttttacttttaaaactatatgtgcaactaccataccacctaggaattgtattccatgcatttatcacagaggaatagaatcttacgttcacacaaaatccatgtacttaaagtttatagcagccttgtttttaatagccaaaattgaggaaaaaatgtatagatgactttcatgaggtgaatggttaaacaaattgtgttatatatccatagcatcgcatagtcctcaataattttttttaaaaaacaacaaattattgatagccacaataacctggatgaatctccacagaattatgttgagtggacaaagggtaatcccaaaggtgacatgtaggattccacttacgtaacattcttgaaatgaataaattatatgaatggggaatagattaatagcggccaggaattaaggagggaaggaggagcagcactggagagacaggttcacggctataaaagggcaacatgaggaattgcagtgttgatggaaatgttctgtaccttgcttgtatcaatgtcaatctcctggtactgtggcatttgcaatacatttgcagtatttgcaaaaattaccattttggaaatattaccaagatgttaccattggaggaaactgagtaaagtgtacaagggacctctctttttctctctgagttcttaagattgtatgtgaattattaaaatgtaaaaattaacttaaaaaaatcctaagtatatttctccttgactgatcatgcctttgcttaaaaacattaaggcaacaatatttttcccaacaccctttattttcttgaagactgttttaacaaaagctgttcttagggcttttcctaaaagtttaaaacttctagtaatccttactgttcttctttgagaaccgtccagggttttgttttatttatttattttacacctttcaaaagaataaagacaaaaactggcaactggcatataatactatattagtcttagtcctccagagaaagaaatgagcaggatacacacacacacatacacacacacacacacacacacacacacacacacacagaagcagagaagcccaagttctactctgagtaagctctagaccgaggagagtcaaatatagttcaagaccaagtccaagacttaaggcagaagattgatgtcctagctcaaagacagtggagaagaaaaacttctttcttaacccttcatcctattcaagccgtccatgggttggatgaggtccactcacacccaggagggcaatctgcttcactgagtttactgattgaaatgtcaatctcttccaggaacaccctcagagacacagtgagaaatcatgtctaaccaaatatctgggcaccctctggcccagtcaaattgccacaaaaattaaccttcacaaaaactctcaatagaagttactaataaatgtagcatcatgtcctgcctgtttatcccatgacaattaatatactccagcgtaacattggcttctgttcccttactgtagcaacacataggagtttcatttaaagtgaggataatttttaccttatgaagtctctccctacccatacataccattgccacttgtggattgtcattttgccatggctttcttatacaaaatatcaacaggctatatactttgaaaatgtaagtttgaatttcatcttggctgcataagtcactttccattttgacaaggcctagatatatttttatctcccgaatatcggtaatgcatacctattttggggcccactcccaatctcacagttttctttgttttcatttagatctcaatagatatgcctaggctgctggaatgtcactgaaaatggcccgtggccttgtccatctatcagagtccagtaaaatcttgaccatgggatgggggaatggaaaatgagaacaaccaaactcagcacacaaagactcagtttaaacctctgtgctaagagttgatcagactctatcatgacttctaatagcataagaccatatcctgtgtatgaccctcggctcccatggcaatgcctgcctaagaaagctcaaggctgccaggggaacttactttagttctagccaatacctgctgatgatggtaggttctttcttatagcacttactaagaagggaatccttcctccatccctttgagatatgtgtgtatctcctagggactccagtgtgtcttttcccaggatctgaaagccattcctttgaggtatagtcctcaggaaggactgagtctctgtcttccggtctctgtgggaggttagaatcctaatgtctaatattgccagctggcagacacagctgtcttgatgaggcagaagcttacaatgactaatcttttgtaatgtttcacttgtgctgtgccctctcccctgcctcactctctgtttagaatgccatcacctctgcacaaatgcgatggagctcagccccttcctctatggtcaatagttactgaagaaaatctgttttcacagctttgactaatgtctgactttatctttgacaaaataagtgtgaccaattgtttttagcggcacggcagctgcaaagagaggcacagacatggtgggagagggaggaatcatctgacccttctcatttcataggcatctattactgcctggtatttatgagcccgagacttggctgggctgccctggtgtatcactccatggctctgaggcaggacttgaataggctggtggtgacacttggtgtgaccatagccaccttcaaagatgccattaagggttcactagaaaatgaaaggaaacatagaaaaactgattttgaaagttgttgcctctcccacttcctcatacagagtgtgtatgatattgctgtgtgatgttagttggactgcaatttagcacaacagctgttctaataattggtagtttctcatcgagttaagcctacctgaaaaggaagcacacttacctttattgattacccccattaaatgaacaatacatccaaaaatgttcttattaacctcatttttctactaaggaaaaactgggaataacacaaatcttcatcaacagaaggatttaatactgactgttatacagccataaaacaatcccagaagttcactcaataacatcaaaaccagaaatccacactgatgccactgatggcagaaaatcatgatacaaaaatgagaaagaggagagagaaaaaatgtactatagccagagtagtgggtaaaagccaaagagctcagtttctactcatgatattcagtagaagaaccgaaggaacatgagccaatagctctaagggtccaggtctgcacaaggtgcctgttgggtgcagggttctgttggctccaatgatgtatcgcaaatgggctaatttttatggacatagccacagcagaaatctatcaaagaataataaagggatagctatttgcatgttaatttaccactgtataggagggagaatgggcattacattggtttggtcaaacaaaagcaaaaccaagatttatgaagaaaagaggaaaggggagaagaaaaaattatctgggacctttgtgattttgctccccttgtataagcgacttggcagaaagctgacaaagaggtcactgtggcccatcttctccggacccacgtgacttggtcaccacagaaaacaattacagatattggaggactttaaaacatcctagaagtttagcagctcatcctaagccgcagaatatctgtgcgtaatgtccaccatttccttcggttgtacaccccctcagttaagccaggaggatgcctctcttctcagtggaatatcatacatcaatgtgtagaaacgtttgttgtgccggcaagtaaatgacagaagggacattgatagaattgggaaacaaattggaatatgatttggtatcgctcccacggaagataaatttgcagaatgtactcaaattagaagcattaaataaatgttgtaatgtaaaaatggcacatcctcctctctacactatagaaatatctgcacaagtgtccaaagatatgtgtacaagaatagtggagattgcggcatcatttgtaatcctaaagccatgaaacccacctcatttcaaaaacatcttgaaaagggttaaatcatgcacaaacagaggaagaaatgctgttttcacaaacaatggcgaggatcaccatgaggatgactgattccactggtcacattattgatagaggaattacttaaacccaggcacatccggggacagaatactactgtaataggtctcctattattaaacatgaaaaactagaggcactttactcccccaagtcttccatgggagcaaagaacatttttatcacaccagaagtgagttcctgtctaaggtctctgggattcttgagtttgacaggtacaaggcaccatgggccttgccaagcctcagacctaagaaggtggggaagaggacatgtgtgtctcctgattaggctggagttgattgtatatcaacagaaatgggttaaaacaacaaagcgaggagtccctggttgggctcggaccaccagcctttctgttaacagccaaacgcgctgattgcgcaacagagaccgctgctactgattctaccgagcgctacatgcagggcacactcaccaaactctccccatcccttttgtcctgagggcctgcccctcaggagggaaaaccggagacattagagcggtgagtcgcgctgatcacgttgcacacccgcgggttgggagattctggagccagaaggacagccgaatggccttcgcccgccctgcccctcgcctgcttcagaagcccccggaaacgccccagtctgcgacccgggcccgagccgcctgggggcccaagggaagctgaatgcccggtgggctcccaggatggctcttccagttcttcgcgccgccttcaccccgtgagggagcctgtgcccacactgcccagtcgctttaggggccgctgcagagcttccgctgccatcttcggatcctgtgtccgcaggcgggctccaccagggcagggatggtggtgagagttcctcgtggtcccctcgcggggagcagggtctgccattcaccagggcgcaggactaagactcgtcgagtgaatccattgtcgcctttaacttttagtcctttgaagagtcctgagaatgtaaatcatgaactatttttctgtggggaagttttgttttgttttgttttgcgacagggtctcacttggtcccccaggctggagtgcagtggtgcaaacaaggctcactgcagcctcgacctcccggggccaagtgatcttcttgcctcagcccccaagtagctgagacgacaggcgagcgccaccacgcccggctaatttttgtattttttgtagatacaggatttcgacatgttgccggggctcgtcacgaaggggaagtaggttctttttaaaaagcattttttccgattgctttatcgggcatcctgtggggcgcgcaagcggcgaggcctccagtggcctctcttgccactcttaggcagggagctgcggggactcagctgcactgtttttgggtgcctgtcttgcgcaggaggccggagccgggcaaggggtgaatccaacagggaattgcgaggaggagggcaaggaagtcggtagaggcgtggaccaggaagaagaaactttccagtagctttgtgcagcggtaaggactgcacaagggagagatgagaagtgttttttttattgtagcagaatggggaagaaaggggggaaaaacggagagacaccaagaacgaacgaaatctacgcggacccttaggtctccaaaaaggaagcagccctgcattacgtttaaacaaagagcccagcgcccttcagctcctgtggcttgcggtgatcgtattgtggttagtactctgcgctgtggccccagcagccttgtctccaatccgagtcatggccacatccattctagggtgtagtgctcttctttccctttcgcctccagtctcagcctaggctgagcctctgacctgcggctagaaaggtcacaactttcctgtggcttaggaactcccggtagtgttgagaatagaaggaacccctaccctgcatgcctaggggtccggttatcttgaaagacttttgcctcctctctgagcaagtacaacacccaaaagatgagatgctccctctcagtcagccttattggaatcttttactgttgacatgatatggctgtacccgctgttctgactcagatatttcaagaatccgtggggccttttcaggccaaatcagaaatgaacaagagaagatgagagttcacactccaactgggtattttaagtaaaacctaacgaatacagtaaaatctaaagttaatgacattctccaaccccaatttttaattttgtttttatttatttattttttgctaccaataaatgactgaagtataatccgcagagaccaaagtgcaccaatcttaagtgcatggcccagtacattttgacaaaaaaaaaccatcacctagatcaagttacagcacattttcaacagaccaaaaggtcgtgagaaccccttttcagtcaatcttcaccccatccccacttaggcaatcactatttgatttctatctctgtggtatacttttacttcttgtagaaatcacgtaaaggactatactgattttgcctgtgtttttctttttttaaatgcaacaattgttatgagatgcttccattttatgacatgtatctcagctctttgctgttattaatgagtgttattccaacatgtgagtatactacagttgatagacaattgggatatttctagtttgggctattgtgaataaggtgtttacaaatattctattatgggtctctttatgggcctgtgccttcaattctgttgagcatgaacccagcaatggaatggctgggtcatgaagtgggtgtatttttaactgtattagaaactatcagacagtattttagaatggtggcactattgtattctcttttattttgttttgttttattttattttatttttgagatggtctcactttgtcacccaggctggagtgcaattgtacaatctctgctcactacaacctctgcctcccgggttcaagcaattctcctacttcaacctcaacctcccaagtaactgggattacaggtgcctgtcaccacgcccagctaatttttgtatttttagtagagatggggttgcaccacattggccaggctgatctcaaactcctgacctcaagtgatccacctagctcggcctcccaaagtgctgggatctcaggcgtgagccaccactcccaccaatactattgcattctcttgccagcaacaagagttacagttgctctgcatttttataagccagtggctttccctgtctcttaaatgttacccattctgatgagtgtgttatggagtatcatggcattttaaatttgtgtttcctgaatgagtaataatgccaagaatcctttcttatgcaatttggccattaagaaattctctttggtaaacaaacactgttcaagtgttttgcccattttacattggcttgactcttttcttcctccccacatttatacacaaacttttctatttgaatagaaaagttgagaagatagtacacagaatggagtaaagaggatggaatgggtttttggaaaccaattcacactttaaagttgttttaacatcctccatccccaaagaacaatgtatgttttctgaagacatctccttattgaaatatgcagagaaagtgtgagataaaagagcatatactaaactcctcagaacgtgtttctggaagtggacagggaaatgggagtgggataaacaaagaaaagaaggaaagacagtaagggccttgctcaaagcagccaccataatgtgccctgagctaaggtacatgattaccttctccctgtgcacctgagatctaagaaaacatattaactaatcagggacatggatttcaaaaacactacagaaaaacagaaaatttacccagacagaccagtctagttaagaaaggcaggaagagattttataaacaaagcaaaaatgcagaaatcatacaatgaggtggtgggaatgagacgtcatctccaatataatactaattgctgcaaattacaatgcacttaagtctctcagatgggatagaaaaggaaatgccagctctaatggtttaatgggcagaaaagggtaaaatattcaaagaagtgcacattattatatatatgtatatatgtgtatatatatgtatatatgtatatatatgtatatatatatacatatatatataatttttttttgagatgcagtctagctctgtcaccaggctggagtgcagtggcacattttcagctcactgcaacctctacctcctacgttcaagtgattcttctgcctcagcctcctgagttgctgggactacagtcacaagccaccatgcccagctaatttttgtatttttagtagagacagggtttcaccatactggccaggctggtctcgaactcttgacctcatgatccacccacctccgcctcccaaagtgctgagatcagacatgtgaatgactgcgccaggtcaaaagcagtgcacattatcttagcaagctaatgcagaaacaggaaaccaaacactgaagtttttatcgtttcttaaaggccaagtgtgaactattgtgacagcttagtctgagagttccagatacatagcatggtttttgcccatttgctgggtctttcctctcacatcctaagtgctgaaaagacacatgtggcagggaaagagagtttcttgagcttgccacagtggtggaggcatataggtcatgattggccaccactagagtacaggcacaaaatctggttgcttctctcacatgaaacaaaaggcatctaccactgatgttggagcaaggaacccttccaaccctggcctatagctggccccaggtataggccagctgctgaggtagagttagacacaaaagctgtctatactggacaagggaagacttgcaatcaatcatttgagttggttgcagaccctttcctttaatgaggaaaaactgtgatgtgggtacaaagttccaacatccagaaagattggccttgtccttaaggatattatgttgattggatttctctcaacctccttcagttgtgtttagcattattaaaattaagtgacattcacttggatgaagtggtaataaaaacaagctgtgagaatttctagtgatttttgataccaagccttgtatcactgttgggctttcatgtgtgtacttgaaaacaaaacatgtaaattgttgcactggtttgaagattttaatggtgaaagcaacctaatcagttatgagtaccacatcgagaaaccaaccttggaaatatgtgattatgctcttttaaaatagctgaaaagaaagatgggtgtggtggctcattcttataatttcagcactttgggaggctgagtcaggcagatcactgaaggacaggagttcaaggcctggccaacatggcaaaacatctttactaaaaacacaaaaatcagctgggcatggtggtacacagctgtaattccagttactcaggaggctgaggcaggagaatcctttgaacctggaacttgaaggcagaggttgcagtgagctgagatcctgccactgtaccccaacctgggtgacagagggagattctgtctcaaaataaataaataaataaaatagccaaaaaaacctgactgtgtgtttattctcactttgttcttgttttgttgtataatatttaaataaaaggagattatttatcctcatactgaatttccaaaactgatatttgcatttagtattttgttaaatgatggagagaaaatttaattgtcttactttgaaaagtttggcataggttctgtcacatttttgatgctttcggtcacagttctgtcattagaatgctggcaattagttacatgcaaggagtatcctaaccactttaatacgatggtttgaagtgctgcaggcagtaactactggacagcagatcatagtgtttttatcggtgacacgttagagagaaatagaactttctgcagtacaaatgtcctattaactaatccttatgctattagcttacagggctttgtctcctgggtctgaaaaaggcagcttctcctgctaaatcctgaatattgacaccaattaatgccttgtcttcagactctggggaagatgacaaacaaaatgaactgctttcacaagacacagaaccagaaattgaaaccattcaatccctttaggcccaacaatcccacatgtcccgttttccacctcatgccccctcttcctctagacagaagaggtgggcacgtgagaattgtaaggctggagtttgagggataagtttagttcagagactttcttttctttccctttctttcttttcttttctttcttctttctttcttttttttttttttttttgtatttttggtagacacaatgtttcaccatattgcccaggctagactcaaactcctaagttcaagtgatccacgcactctggcctctcaaattcagagattttctataaattagacattacagtcaggagcacactgatgcaaggccaacatctgggctcgtgtattgcaatatcagggttttctagagcatttatctactccttaatacaaaagtataaaaggttatgaaaggtttttggaactcttacctcatggtcaaactgacttttttttttaatgcctccttataatctttttaccaaaggtatattttagttttcttatacaccttgcacataaactgtttctttaatagtactcaggaggccttattacttttaaattatacaactttgtttgcataaaatttttttataactttttttctttcacgacttccgcagacaatttttcaacatgtctcaactttctgacttattacaaacacttttttctttaaacaaccagttaatttatttcaggacaagaatttaccacataactttttgtttgtataaattctgcttcctccttttttttccttttttaaagtgaactttctttatgtctttggatagactgtctaaggccacaagattagaagttaccataatacatgttacactgttaacttttagcaaacttcacttttgtagaaaaccttgtaagtttgggatttcaattgtcctttgctattaataagaccttgtttagtctaaattaacttagaattggtatagatggcctctttttctctctgatggtctttacttgcctctgccagctgcttatgctgctgttctcttaactactgcgggcagggaaagggggtctaaaaccagctgtaactgtccatgtacggaaactggtctgggtgccttggcttagaggttaccttatgccatacctttgaaacaagggacctgtccaggcttccttctgatggccaacctacatctaatgctggccagtctatttcacataaagttctaagtttttctggagtcatagtgactccatagtctccattgaatcctttcttgaaattttttaacatagttcctagtggggggggcttatttgtgcctgacccatgtttcttcaagacaaaacaccacgctcacaccacacgccacacaccacaaaacaaaaaacaggtaaaaagggcacacacacacttctgcagtttacaccaaaccaaaatcaaaaccaaaatcagagtatccagaaatccaagccaggtcaaaaccaaaaccgaagtatcaggcaatctaagtcaagtcaaaaacaaaaaccaaagtgccggtacaggcacactgtgggtgatcaggccacgcttccactcaaatggagtaggcaagttcccaagaccagtcctgtcaagcaatttaaaccaagtcaaaaccaaatccaaagtgccaataaaggcacgctgtgggtgatcaggccacgcttctactcagatggaatgggcaagttcccaagactagtcctgtcaagcaattcaaaccaagtcaaaaccaaaaccaaactgctaataaaggcacgccgtggttccactcaaatggagtgggcaagttccaaagactagtcttaccaagtttcagatgtccggactccaagtgccagttccttcccggtgttcagccactgtgttaatcctccgcgggggcctgctacgcattgctctggcaaggcgttccaccggggcaattgcctaccccgaagcgctctttggatcatgtcactcaggctggccgaagtctcccgcagagacgctgcacagcgcaggcttaagccgcctaaggggctgccttggcagtctgtcagtcacctcgcttcccagtcagggaaccaagaaaggtagcaggatgagtcgcaaacaaaacctctcagacacggagttgtagaaggaagggctttattcagctgggagcatcggcaagctactgccttaaaatccgagctctggtcaaactgattataattaaacttgtgtataaggttttattaaaattagctttaacattttaatacaccacacaaaggtaaaatttggttttctcttttgatcaaaatgtttgtgtagtattaataatagataaaatatttttgtttactttcaaagtaaactgcagggcaaaagaaggaaggggagagacacatacacatggcctcatgttgtcttcattagctcttactgtttagaaaactcagcctcttttctagcaaagggtgaacatttttgttttatcattttggctaaatgattgactatactaaggtgacctgtgatcctattttgtgatgtcaagtgtctcaaaactttgatatctggcaaactttctaagagtaaagtttctaaattcaaccctttgggcctcaaattaactttttggatattaggttcttgaagtccaagagagatatattaggcttcttagacttatttgttatgtagaattatgcaaggagcattgtcaaatctgaggtggtgtttcacttcctttgggttctattgacacagatgtgttgttaatgtgtgttccaggattgtatgagattcctagagttctgctatgctgtcagtaataattatgattattatgttaaattgttgtgtgccacagaaacaacagaattcccttgtcaattgtatctataactatggctgtcttaaggcttttgtcatccacaattgttgttttgctttgattcttcttaaaaagtgacttataatcagttacagtccaggcctttcttctttggggaagtccatgaaaaggactcttggatgcaggactcttctgataactttggagattgtgccactgaagtaaagagaaaatttccagggcactaatagaaagacggatgtgttcatagagattgctaccccaatgtgacgcagagcaggagttgattgcatggattgaactaatagaggactgaaataagtttttatggcctttgtttgtttcaaacattgttgattcttcagagtctggagaacttgtttccttttgagctatttatagactgcaacaattgagtagaatcgtcttctaaatagaatttgaggcatattgttctctctctgacgaatttctacagaatttgtaaactgaatattcttaactcatgacaatgtgtttgtttgcatgagttcaataagattctgttttcttttataatgggacacaagtggaggaactggtaattttcccagggctttgcctgaaatggtgttgtgaaatattccagcaaagcctatttaggagagcctatatgaacaaggattcttgctgcactttgtgtgggtaatcaggccaagtatatgggactgaagcttcttttgcaggtaggttggtcctgctgtgttttgtctttagtggaagtgagggactggagagaggaagattgtgtttcaggagaaactacagtattagatgaatgtttgattcctgggtggccatgcagtcacccatggtgtggagctgctcaggatgcccctcctccacatgatgcagccagaaagatggatgatcagattccccatgattgaggaactgacaaatagaaagtggggactgaaatcaacccaagagtcccacagacagtgtttttggatagacatagaaatggacccttctggtcttaaagcttgaaacttaggacatttgttttatctgagttccttcctcagcaaaggcctctcaggcctctcaaaaagcgtcatagacctgaaactcagcagatgacagcctccagacaatgagatgccagacccctcactcatcatgagtgcttcctcacccttccctagttcctcttttcccacccacagttaacatttcttccctgctacataaacccctcactttagttgatcagggagattgatttgaaactgatcttccatctcctcagctgcagcacccaattaaagccttcttcctcagcaatactcaatgtctcagtgattggctttctgtgagctgagtagcagggcctagaccgaactcccgggctttcagtagcaatacatgtacacttttaaagactgtaattaatgggtcatgatatattgacaaattgtaatggtatcaacttggccaattctgagaaaatacactgtgcttcaatatcagggccctgctcctgacctcgacagtatatggctgattttgagtcatagtaggagagtatggcctggtttgagtgttttatagaaatgtaaacatggctgattgcttttattttaaatccaacaaatctccatttctggtgagaaaattttgttaaaaccaaccaaccaacgaaacatagaagaatatgaataaaaaaataaaggattccctgcttcccaatctcacttgattgctgtcttctattatatgctacagggaggaagggggcaaagtgcccaggaagtcccatgtcctgttttgacaatcatctggcctccttgggcaaatggaaaagagggaaagcatcaagaaaataacagaaattttgcagatatttcatctccgggctgggtgcggtggctcacacctgtaatctgagcacttcgggaggccaaggcaggcaaatcacttgaggtcaagagttcaaaaccagcctggccaacatggcgaaacctcatctctagtaaacatacaaaaattagctggacatggtggcccacacttgtaatcccagccactggggattacaatcacttgaacccgacagatggaggttgcagtgaggggagattgcccactgccactgcactgcactccagcctgagcaacagaaggagactctatctcaatgaaaagaaagatgaaaagaaagaaagagaaggaaggaaggaaagaaagaaagagaaagaaaggaaggaaggaaggaaagaaagaaagagagaaatttcatctcgacacaggaaactctgacctaggctttaaggaaagaaaagaaagaaagaaagacagaaagagagacaaagaaagaaagaaagaaaaagaaagggagggagggaaaggaaagaaggaaggaaggaaggaaggaaggaaggaaggaaggaaggaaggaaggaaggaaggaatgaatttcacctcaaaacaggacccagactgtgtcggtcctgaagcctctgtgaccgaggcttcaagggctcttctctggccctaaatccacagtggattttgccttattttccgaggtgcacatgaaatgatagaagtcgatcaaaggagagggcagagagaaagcaagagggctgggtccttcctgcaggtccaccttcctcaggtattgcttgtgggatcaaaagaaatgccttgacatgggtgggtgggaactattgatacttattaggaatccacacacctgcagaaaacttgcattgtgaggttccatggtgtaatggtaagcactctggactctgaatccagccatctgagttcgagtctctgtggaacctttctgtgtaactgggacgataatgccgtcttttactccctaaatggaatggggattccgctgacgttcttcagaagctctgcgctgcgggcctccgtgtcccttctactcccgctgtctgaaccccgcgatgtcccccgcgctgttcgtcccctcttcgtctccctcttcgatgttccgggtcccagaaaccaggttatcacagtggcccggatcatagggaaattgcgaaatcatccagttgggatcaccgagcctgcagggtccccttcctgggcgagcctcctggccccgtgctatcggaggcctggacacccccgccagggacccagcgacccagcaagtccccaccccctctaagggcgacctgggcctcggggtgagaggtctcctacactaaaaaggctgccgcccttcaatcctagaccccgagattcctttcactcgggaaatctcgtaatggcatccattgtcattttggtaagtaaatggcgtgagaaaatttgatggggttagctcagtcattggaaattgtgtctcagtttacgatcgatggtttgagacctaacttgggagtagcactgttttattcagatggcccatcctattccgaatgttaatttgctctgttcttcatattcagatctttatgccgaatttctagctcctgcgtctccattgccggtcctaaaagtcgccgtttcactaagcttcggaacctgactccgagaaatctattcgttcgtcccaagatctcagccagaaagagaaatccgcgcggcggcctcttctagctcgggtgctgggaggccccgtcctgatcctctgtcgccctggccgatctccctcagggccacggggaagaggaacctgagcagctctgaggggcgagtctctgacggtggggctccccctcgtcctgccaggaccctgccccaaggagaagaccccttaggacgttaccagatttaaacaatgttttctcctgctcttcagagcacctgggataaggttcctgatgggtcttgggagcaaactaacatgtcgctccaggcgctcaagaccatccctctgattttcatattttggggctgagagcgtttaagaaggactgaaaaacgctgcagtctttgaggggctaagtttggaggatgcgggagtgggagaggatgccttcttggctccttggagtggactggcaggtaaggaaacacaaactccgtttccccttgcaggctggactgcagggcctgggatggaaaattggaccgtcaaagagtaacagtatttatgtagaggttggctgcattcattaaaaattgttatccctacagataagtgtaggaagggaccagggcactgccgttcaccaccagctttgcagcatatgtgactttgaaaacagtgtatagtgcataaaaattcatccctctttacaaataattgatcacaaccagttacagatttttttgttccttctccacttccactgcttcacttgactagccttataggaaaaaaagttatttgtaaatatgatattgtttcagttgatcctcagcccgcccgttccccaccccctgaaagtagctggaacaacaggtgtgcaccgtgtgctgggctcatttttgtatttttagtaaggattgccttttgccatattgtccaggcagctctcgaatgcctggactcaagtgatccgcctgcctgggccttcctgctcctccctgctgggattacagctgtgaaccaccccacttggccatcaattgtattttgaatttaaatgttttatagtcatcattcttcaaatattcttggttttgttgcatgtgcatgatggggttcaggacatgctaccccaaaatataacatcttggggtattgaatattttatgttaagggaatttgaataaacaatagaagcaggaaggtcactgtcaccctccccctgcccttctttcctgaagtcgattatagacccttatgtgagatgtgccctctctgtacccagaggaaaggtgcatcctggagtctgaagacacagggacacagagaagagcctgaacacagaggcctggccccgttttccccagtttgttactgttagatcatacttttattgtcttatcatacttctccatgactatccattcttcaataaaactactcttaaaaaacaaacaaacaaacaaaaaactgaggtttagctgtttccatgggccttcatttcctttggaaggcattcctgtcatgtaaaacttacattaaataaatacatctgctcttctcttattagtctgtcttttgctgtgagggtctcagcagtgaacctaggctgggtgaggaaaagtcatatttcctccccgacatgtacaaatgtctttgactgtaaaactataagaattttactggggcagatttgaagcaagaaattgcatcattattcccctttggatgagctgaacagatgagctaataaactcccagttccccccagatagaaatacttctctagctcattccctgaagctcctagagggtcaaacctgctggagattaaggggccttcctgggatctcccagcccaggaggttactgctggtgagaggattgctgcagtctccctgggagggtgcatggccattggaaagtatcactgctgtaacttcagtacaactggttttcatcacatctgctctttgtgcagtgttgcaggcaaaatacaagagctaacatgcacatgagaaacacatgcacatcatcaactgtgcctgcaacacaaagtgccacatgtcaggcacagttgatgagtgtgcatatgtttactcatttagtccttacctcaggccgaggtcacatcatcaccttcatcttccatatgagaaaactgagatgcacaaagatgttaagtgacctgtccagggtcactcagccagcaaagaagaatttgaaagcaggaatttgaagtgaagacagcctggctccagaagacattctcagaaccactgtgtttatactgctcctaacaaaatcacccttgcaaaaattatgacagtgagaaaaacctgacataggaaaactatgactgtgaaagaaatctgacctaactgactgcatcttgcttctaatctctgagctgcccttgtccattcctgggaataggccaggctaactatgagaggagtttagtttagtctaactctgaaacaaagatgattgtcgctcctgagacaaaccccttcctttcttggggatcagacctccttagcaaagctaacaaattaggcacgagattggaatttatggctcaggagccgtgcagccagaagtcacatgattcctaagctccccaattgtgcctatatatagtattattagtgtcaaacctaatattggtgtttaagatatttttcagaccctgccttgtgatggactagctggtaccactcagactggtaaactggctcatctggtcctgtggccccatccagggactgactcagtgcaagtaaacaagctcttacaccctgtgatttccaaccaatcagctttgcacattccctagccccctgcctgccaaactatccttaaaaaacaaaaaaccaaaaaccaaaaaccaaaaccaaaacaaaacaaaaaccctagtctctgaattttgggggaggcagatttgagtaataataaacccctgtcctggtccctcagctgcatctgcatttgttaaattctttctctattgtggaaagcctgctgttctcagctccattggcttatctgggcaatgggcagaataaacttaccaggcagttacactaataaaagagaaacacaaattgtaagcatgcttcaaaagaaatgttaagtctttgtatttcttttaaagaaacacaaaaggaggaggaatgataagacaggcaatacactgtcctaaatattttcatgattctcctgcctccttcatatccttcttatcccaacaacttctccccagaaaccttcaacttaaacatggtcctgccagaactgggtttgtccttcccttaacattttcctctcacctgccctacaccccttccaaatctaatctgttcattcacttccaggtcattgaggattttccatttaaaaatataaaaaattcataaagaggaagataactggtcatccatattcacacctcctggaattaactactgttaacatatctacatatttttcttctgaatcatttttaagctattgtctttttttaaaaaaatttatacatgctaagcatagaccgtactaacagtagagaaaatgtaaacatatgtaaaatttttgatcaccttaagttcaaaaataacttctcataacattcgggcaacactggagtcatggtattgtgttatatctacagagagaagaaagtatattttagctagactgttccccccaggccccacaaaagaaaaaagaagaaaaaaaataaagaaggatatatatgcctgaaaaaattataaaattataaaaatatataaaatatatatttaatatataaaattatatagtatatataattctatatttaaaatataaaaatatataaaaacatatatgtatgcttttataaaattgagcttagactctatttttattttacaaatattccacttaatagtgcatgaacttaactgcagacaaagagacagaaacagaaatgaaggaattcctgaactccctagcacagttagaaagacatttgtctaaacgactcctctaagggcaaacatacattaaattaaggagaagacattaagatttggagtggttttcttattcctttttacaaccaagttaaggtgtgagttgcctatggtacaatgcatccatttcaagtttgatgactattactctaaaaggtcctcttgtgccctttgcagtcagtcccgccctccccctggccccagcaattaatgatgtattttctgtcactatacaggttagttttacctgttctagaaattcaccttgatggcgccacacaggatgccctcttttcatcactcggcatgatgtttttgaggtaatccatgctatctcatgtttctgtaatgtgtcccattttattgctgggtagttggggtagatcgccgacacattctgccgacaagtcagactgcggttctgacctgaaggcctcggtgaacataagcaagggcacctgggcgcggggagagccgttcccctacagaaagcaagcgtgttgtgtctacaaccgaacagggacactgctttcatcccaaagaacagcacccgtctgcctagaatttctacctggctctaggaggtgagaacacattccccgctagcacagaaatcctacaaacttctgtgggggctgcggttagaagcacaggctgtgtgaaaggtgactccgggggctacgaaaaaacacgaaggttttcacatagggtgagaacccaagacactggagaccatgaagcaatcttgaaaaagcagccccacgtggaaagggaagagaagagcactggggccacttagcttgcgttaagcaagctcatgataggggcggagaggacagtaacacaatactttctctttcttatgcttgcgactgtaggacaacacttaacatgccagcaaagctacaaacccgtagaaagctaagtagaaactaagagtagcccttcctgcagaattcactttttgcactgcaagatttcagcggaaagcactaacgcagttctccactgttattgtgcagccaaatttctcccatttgggttaatcgcaggatcagcacgtccacagtgcaatggaaaagcaacgccctgggaaaacaaccttcataacgtcctctgcgatgtcaggtaattaggagttcacacgtttccgtcttgctactgctccacacgcctcaccctttttacacacggtcacttgccccgcgcaccccggagcccttccagccttgacacacagctgggactttcaggtctgaacagcggtcctggacttgctcccacagcacgggaactccttcgtagcgaagcagccggtggcgaagcagcagcccctgtgctgcctcatctacatagaagtcgccctatccgtgatgtcactgacagcgcctttcccgtccggctctgcttttccgccccaccttctgccactcagccgaccaacatgctgccagagactgcggggacagtgacgtctgcctttccttcctttccctcccttccccgccccaatctttccaaagaagcaggtgtttctgttgtagttttttgttttgagccgcagtctcgctctgtcgcccaggctggagtgcagtcgcatcatctctgcttcctgcaacctccgcctccagggttgaagcgattctcctgcctcaggcttctgcgtagctgggattacaggagcacaccaccaagccctgctaatttttgtatttttagtagagacggggtttcaccatgttggccaggctgatctcgaactcctgacctcaggtgatccgcccgcctcggcctcccaaagtgctgggattacaggctgagccatcatgcccgcccagaagccggttcttagcctgtgttgccgatgacctctttggcagacagctggaggctgtccacccttcttcaaataatggtttgtaatgcgcagactaaaacatgtaggattacacaagaaactggttctcttcccatcgttattcttctgatgtagcattctacttgaaattggaagccgttcagtatcagagagaaaccatatctatgaaactagagatgctgctcagatgactgcaaaccagccatccttacttgttttaccattagtagtgctataaagacggtggtccaatttcatgaatcttgtaggattttttcaaatacagcaatgtacaaatatgctgccccagcagagcacactggacactcgggcatggtgctggagtttgtcatctcttccatggccttctgtagaccgtagcacttacctcatgttagcactttatattctgcaaagagagaaacaagtggtccaaatttggagaaaaaaaattgggggaaattttatttgaggtgcttaactgattacttttaatttgtagaatacaatcccaaactctgacaatactccacagactccaaatctatcaggcaagtttttcctgtcctttgctttcatataaatcaaatcataaagtgtgtagtgggttttgggggagtataactgcgcagtgggttcctgttgcctgctgcctagacagaaccaatttatcaagacaggggaattgcaataaagaaagttgtttacccagagctggctgtgtgggagaccagagttttattattactcaaatcagtcttcctgagcattctaggaccagagtttttagggataatttggtgggtgggggacagtgagttgggagttctgattggacaggtcagagatgaactcacagggagctaaagcatgctcttgagctgggtcatttcctgggtgggggccacaggatcagatgagctggtttatccatctgggtggtgccagctgatgcatcgagtgcagggctacaaaatatctcacaaaccgatcttaggttttacaatggtgatgtgatccccaggaacaacttggggaggtttagaatcttgtaagctagaggctgcatgatcctaaaccatgatttataatcttgtggctaatttgttagtcctgcaaaggcagcctagtccccaggcaggaagggggtttgttttgggaaagagctgttatcatctttgtttcacagctaaaccataaactaagttcctctcaaagttattttggcctgtgcccaggaaagaacaaagacagcttggatgttagaagcaagacggaagcagttaggtcagatctcttttgctgtgataattgtcccagttataattttttcaaagtcggtctcaggagcagaggcataggtttgatttctttcactcagtcttacatctatgaatttttcatgttactcatgtggttatttgtttctgtgcacaatcctttgtatgaatatcggccaacttatctatttattctactgttgctgaacatgttgacctaaaagaaagaggctgaatcacaaaatagaatctagagtttacttgagccaatgtgaagacagctgcctggaagactcacacccaaagaaccttggatctgagctccctttggcctttgtcacaagcaggtttttaaaagtcaaaagggggggatgcacaatgggctgatagaaaggtgcccgtcaggaattctcattggctttcagaaatagcattgatgagagcttggctatcccttgttatagggtgtgggatacagtgtttggtgtggcattattagattaatttacagctacctggggtgatagcaagcagtttcaacagatgaatacatagctcaaaaagaaggaagcagaaagtggttgctgtcttgatttaatgtctctctgatcatgtgaagtggctcacattcctcagataaaaattctttaaaaaatctttcttcttgaaagcattgatgatcaaaagctcagccaacgtgtccctctttgccaggaaagctcattcccagatagtctttcccacggtgagggcaggggaggaaaggagctgcctcactgaggaatttttaagagcacccaaaagcccaattgaaagggtgacaccgagtagaaaaaaaagaaaaagagaagaaaagaaaaaaaggaggagagagagacctcagttaagtctgcagctatcactcgttgaatcatttctagtcttcagataccataaaatcagttttctcagaagcaggaaatatatagcattaattatttgaatagtacacatataattcacacaagaatgagaatcacaaagagaatctgtatgccagaacagtaagggaacctattccattagggagccaacgaaaaacatcagggaaaacatcacatcccagttcttctttcatgatttcttgtagccaaatgacttctaattttttctagatgaggttctacttcatgggaagtatttatttatgtatatgcaacaagaggttgtaaacaccacacatccacctccctgctcagctaaatctatcatctaaagcgggctgcggaggctgctgttgctggggctctccccttggtgttctgggctgcgttgtactaagtggagaaggtggttgtgggcaagcgttgtgcatagatcacaaccaggtgggcagggggctgctctctccacactatcagttgacaatgtacaattccttttatgaactcttgtaagtgctgctgtatctacccattgtttttgttttgtttttatttttttgagacagagtctctctctgtctcccaggctggagtgcagtggcacgatctcggctcactgcagcctctgcctcctgggttcaagcgattctcctgccacagcctctcaagttgctaggactacaggaagatgccactgtgcccagctaatttttgtatttttagtagggacggggtttcaccctgttggacaggctgatctcaaactcctgacctcaggtgatccacccacctcagctgcccaaaatgctggcattacaggcatgagccacctagcccaggttctacccatttttaaataaggctaatagtgtctttgaaaatatacatcatctaaagtgacgcgattatctagtacaaccttagccagtgaatgaatagctttttgatgagctgtgaaagaggctacagtttcatcagcaatacctttctttctttctttctttcttcctttctctttctttctctttctttctttctttctttctttctttctttctttctttctttccttctttctttctttttctttctttctttctttttctttctttcttttttccttttcttttctttctttctttttttttaagacatggtctcgctatgttgcccaggctagattgcagtgatgcagtctcagctcactgcagcctcaacctcccttgctcatgcaatcctcccacttcagcctcccaagtagctgggattacactgacgcaccactacccccggttaatttttgtatttttttagtagagacggggtttcaccatgttggccagggtgttgaactcctgacctcaggtactctgccctccttggcctcccgaagtgctgggattacaagagtgagccatcgcgcccgattcttttttgaatgtttggaagagttcggctgtgaggccatttggtcccgggcttctctttgttgggaggttcttcagtccttttatttgttattggtcgttcaggctttcggtttcttcttgattcaatcctagtcgtttgtatgtttctaagaatttatccatttactctaggttatccaatttgttggtatagagctgttaatgatagtttcttatgatcctttttacttgtgaggcttctgttgtaatacctccactttcatttcggatgttatttatttgagtcttctctatttttttcttagtttagccaagtgtttgttaattttactttttccagaaatacaacttgggtgtgagaggcctacgttgcatcaccactggaggccagtagttcccagtaggcctgggaagaatagtaagatgttgtctctcctaaaaagagggagaaagagaaaggaaaaggaaaaaaaaaacccaacaactcagttttgtttatttttctgtagtatttctattcttcagttgattgacttctgcatcgatatgttgtttcctttcttcactgaactttggatttattttgttgtttttttcctggtttcttgaggtgtaatgtttatttgaagtctttcttcttttttaatgtatgcatttatggttataaacttgactcttagagctgtttttgctgtttccaaaagattatgttgtttgttttcacttttgtttgcctcaatcaaatttcccttttgatttgttctttgatcagtcagttgttaagagttatgttgtttaatttccatgtatttttgaattttccagttttccttatgtagttaatttttagtttcataccattgtggtcagaaaaaataattgatcggattggaatcattgttaatttgtctaagatgtacttttcattattttaattaatgtataatagttgtacacattttggggatacacatggtattttgataaacatatacaatttgtaatgatcaaatcagtgtaagtagtatatctgtcacctcaaaactttatcttttctttatgttaggaatatcccaattcctctcttctagttattttaaaatatacaagaagttatttttgtatatactatcaaatactagaacttattccttctatttaactatattttatatgcattaaccaataccttttcttccttctctcctgtctccttctcagcccatctccttctctcagcctatcccctatctccttctcagcctcttgtaaccactaatttttatatatgatatgacacatgaattcaattttttctacttgtttatttttatatagttacaaatatgttacatcaattgcttaaaaagaaaatcctcaatcatttgttgaaatattatgtatttttaaatacattgcttttttaagattgtcaaaaatctgttctcaatatatgtattggtttatatttggactctattttcttttgatccatttaattgatcacataccaaagctctgttgtggccattacaactctgtgattgttctttaaatcaggtggagctagccctccaattttgctcttcgttatataggcatttttgttatgctagttcatgttaattttagaatcagctgccattttctaccaacgatgcatgctgaaattttgagtcagattgcattgaatttatagatcaaattaggggaaatggacatctcaacaatattcttacacatgaacaaacaatatctttccagttattaggcctgcactatgttctctgtgaaatatgctctaattttcagtcatattcacatttatggattttatacacttgacattattgtaaatgatattccttttacatttaaattctgccgtgcaattgcataaatacaatttatttttgcatattgatcttatatcctgctagaaacaaatgctttttgaattcaggtttgatcggccagtggcagtatctttggaaactttcatatttaccaggcatgaagaatctttctcatttcaattggacctttatcaccagcccaagggagaggaaagtcctaacgcatatcaagttctgaggttgggaagagttgtactttgtagataaatgcatgtgaaatgttctgtatgtttgccaataagttttcattaagattactcatgcagttataaggctgcccatttgcacttgtgtttagctgcaatactatagttgtaaaatttagaagccaatgttctcccttagtttaaaatttaatattcaagaatttactccagtattatgtagtgccagaaactttgggatgatatgcaatgatatgtccagcaagtatgagtttgtacctgatccttattagtcttccttctgatgtgatctattataaaatgagaccttaaagagctttaaaataattaataatggcatgctgaggagattagtttgtgggatattcagtagccataggaaacagtagttcctactctgtatctcaagtgagagtccactcttcagtatgtcagcttcaagaccctgatctgcagtggaatttgcagccccctgctgtgtcagcttcattacttcaagggagggtgaatgccttcagttctttaggtcacaattgacacatgtagcacattttggtacctcttcagttactgacctttatgcccactcatgtcaggcttgctcacctgagtgattcacaagatcacattcccaatgcatcagatcactgtgtcacaaaaaaccaaaagcatttatttgtcattatgtatctctcctgaatttcaaccttgataggctaacatggctcacaaacagctttaaatttggcttctcaaatgtctgtctaatggtttacaaaagtccagttactcaaatgaatttatcttacagtccggtttctattgttccatgctgtgcctcagtgacataaaccaagagtcagtatatacaaagatttattcccactggtttataaccaaccaataaatagtatgcctgttatatatagttctgtgcattgggttgccagtctccttccttcttttacctgattgttattggaagtggagatgatgtaatgttatgggtcacttctattagcgtccctggactacagttctaccatctattttttaagctgttttaccttgttatataagatctgcatatttagtagcatcatttatgttattaatagttaacatctatggtagtcacttctttggttaggtcagagactaaaatctgaaaattagaaatccattctttatttcaggtgtgtgcatgctgttgtgttgatccctctcctctcccagaaaagtcattgtaggcccaagttgatgaagggacagactgtgaaagaatggatgcagagcatggactaagtatgcagtgcccactgagttgaaaatgttgctaaagttgcttttctgcgattgtctaacattcctctgagtcacctcgtctgctgcttaagaaccccaaagcattttcttcactgtcttgtggccattgttataaactccactctgttcttcctgtgtcaactaccacacagtctgtttcattccatggccctaaaggcagagccatttttccaattttaggtacactaagggtatcctgtttctgcaaaaccaatggatgttagtggttctcttagttgttgttgttgttgctgttgtttttttttttttgacgtatgaggccataattggagtaatgtgaaaaatattttttcctccagaagttattagatgctgctatatccaatatttgttctatcagtacactataatgtatcccagctatgcattttatatttcctaaaacttcacttctgagaaggcccttcacgagtttttagaaattcatggcccacccagcagcattactaagtcttttggagtctagcctcatggtctttctgttgattttcctgctgtcaacatgtaatctgtgaaatgaaacaaagggaggggatccaggccaagacttggcgacattcatttatgacagtcagtagtcagacactatgtgcagagatcctccagatcctgtttgaccagcatctttgggaggttaagagcccagccctgtcagaaccactattcattatcatcgaccctttcaccagaatgcacctgtgtgtcggctactgattttctcacctccaggcaactcaggctgagctgggagcagaaatcttaagctcttgtcactaaggactcttctgtgcttcctctgtatcacccgccataactagcataatgctttactcacaggggctcaggaaatgcacttgttgagctcaacaaattgagaatccaagttgcctgataagcagagatgttatggtgtagagaattggatagggtaagcagaggaacaaaacaggttgtcattttgttgttattgttgttgttgttgtttcttagagtacaaaaattgtgactggcaactgctggggaatcctaaggcaggactttagtccctaacccccctacattctcactacattcatggaagctgctttactcctttccaccttaggtatttaatctataattagaggataaaatacacaatttctaaatgctagtactatgactgatatagaatttattttggacacaggtgaatcttgaagtctgcaaagcatttcaattaccaaacagaggccaggcacggtggctcatacctgtaatcccagcactttgggaggctgaggtgggtggatcacctgaggtcaagagtttgaaaccagcctggctaacatggtgaaagtccatctctactgaaaatatagaaaattagccgggcatggtggcctacacttgtaatcccagccactcaggaggttgaggcagaagattcacttgaacccggaggcagaggttgcagtgagctgagatcatgccattgcactccagcctgggcaaaaggagcgaaactccatcacaaatatatatatatatataaaagtagacagaagatagatcatctgtgattactatgtcaaggacaattttagaattcttgttaaactcacctctttcttttcacagctggccaggacttagtcagtatctactgaaaccttgaatatcttggctgtgttaactgttttgacccaacatggagcgaaaatgttggttgtaccttgagattctgacatctggttgaagtccaggttcactggcccaggacaggtcattcagctgtttgaaaaaaaacagaagagagaccaggccatccactgaggtaatctccatgcagcatgaaccactggttccaatgaacccaccatcaccatacttctcaggaatcgctggtcactagactgagagttctgtgaaagctgagatcatatcttactaatctctgtgttcatggttcccagctcagggtctagcactgagggagttctcaggagagtgttcatcaattattgaataaaagcgattgcaaacctcctctcacctgcattcctgtcccaaatatcctgtcagggatgctgagatttctcccaggatgcagcaaatccctttccttagactggcccttgccttacaccattcatgccccaggatccgtctctgtgggacattagaggaaaatgagtctgttctgaagaagtcctcttatggttccccctgtcgttaggagcaatgtcttcacctaaactcccactctctgggttgccacaacaccccaatgtgggggaacttccatattttcttaaaatgctatgtttctgttctttctctcatgggcttgagttcctttggggagacattaatatctgaatcccaagtgtttaacacaatgtaaagaaaattaaacacccaataaatatttatgagatatcatttggaaacctccttcaactgtaagtacagaagaatattataagtatcactgctttgtatactagcaagggacgcttactctggcacctgacctagggcagagctttttatgtaagaatggatgtctccaacccttctcccagcatggttattccctctaacccacactgacctgaagagcatccactgctatggcagccccaaggtcaaggctcctgggtctggggcggggctcatggtcgcatcttccccccttggagttgctgctgccccctcactataaaccagctctgatccaccctgtggctctccctggccaggggcaggagactcctgtggagtaaatttctctctcagtccccactgctcagctcacgctactccttgagggcttggatgatgataggcattgcccatttcccctgaggcttctgtcccaatttgtccttatttcccccttctttggttttcatttaccaatggcttgtcctttgtgggttgttctcatcccctaaacctgctgactttctttctttcatctgttccctcagttctgggcttccagtgtagggactcagctcaggctcctgcaggagacacacagagtcaggtctcagctgcaggtcctgggtggcattaaaaaccatctcagttcctcagagactcagagaaaacaaagtaggaagggacctcagagaggaacaataagcccctaactcactgaggaggaaagtgaagccaagaaagactaagactctcccaggctccctcaccacatggtggcagcagatcgaccacacaagccttggcctcagcctccaggtctaaagcagctaactcaccctccaggaactcactgctgtgtttcagaaaactttggatcaaaaacagcaatttccactgtgaaaacaaataaagtaaaagggcttttccttggacaaacgctttataaccgttctacagtcctagtatttatgctcagtcagttgtcattcactggctggtagattggggcagggagcacataaagattaagtaatgtttaacacaagcctgctttcccagcctgggatctcagctcctccattcttcagggagtttcctctcctgaaactgctggagagtctcagccctcatgtgggtcatttctccatgatgatacctgttattttcttcctctcctggagataagacagggcagagattggttctgggtctccacaattctaggttttctcctaaaccagccaggtcagctggaagcaatcatgacagagaggtcaggtcagtgaagagggtcccaggggagcagggggtcacaaggacagcccctcatggagatggtcaggaccgtgacatgggcaacatttgaccaattctgctggggataatgtgccaaggattaaggggaggatgctgccataagtagaaagaggaagaaccaaaggagtaggagaagaaggaaaataaaatgatttctataaagatagaaagaaaggcagagcccagaggcaagccccatgtcacagagggttagttccaggttttggatcctaaccaagaaattcctgctggactttgctcagcccaatttcaaaaaagttttggatcagtgacttctttgttacttccatgtttcccctttgtgaacaagaatcgctagaatcatttttctatgtctgtcccaccattgcacacagagggcagataagccgtttgttcagtttcacaggttgatagagggaagggaattatgtcaaggatctggacttaatggacaccctcagaagcctcattcacacttggtatagttgactaagataagattttaaacttttgatctggtgtggtctacataacatttttcactttgagctaatgctttaatgacatgaaatttggaaaccttagagtagagggtgaatgtattttgcaaatgggggaatgtgagtgtccgactgtggtagatggaatttctgaaatggcccccaaacatgccacacccttgtctctaaagcctgttaaggtgatgaaacatcattcctgtgattatgttgttatatgccagttatatgactttaagatggtgaggttacctgtgtaaactggatttaatcacatcactgcacacatgccagtggtttctctagctgtcaggagagggtgatgtcagaaagaaagggagcttgagaaggactccatgagctgttattggttggaaaatggaaaaggccaggtgagaaggaatgcaggtggcctctggagttagagcgtctcctgcctgacagccagcacacaaaaagaaaacccagtctttcaaccccccaaaaatgaattcctcctacacctgaagtgaacttggagaagtagcctgagctccacataattacatagccagacacacctggattcagcttcctaaaacccttatcagagaacccagcctctgttccagacttctgtggtttcaatccactagtttgttgcatgtgttaataggcagcaatagaaaactggtacagatgcctatctctactcttgatttattatttcagatacatggaagctaatccctctaagagaaaaaaattaaagagcaaagaactacagcaaaaatcttgcgctcacgttcacctttatgtcactattctggagcccttgcaacctgaagaagataatgagaggcattccaagcatgtgaggagtatctctaatgttaccaaccaaatttctgaaagaataaagatggtacaatactaactccacataatcttatgtgcaaattcatcatctatctctatttcttatagcagatttctttttcttttttagctcattcatttaggcttgccagatgaggtttggtaacaactatcagttatcagcaaaaatgaaacaactaatgaagagcaatgaacaggactattatgttcctcaaaaaagtccctaaaatgcaatatttcctctaaatgtcacaaaagtaagacagtgattcactattaaaaatcctaatctaagaaaggttgaaatttaatgatgttggttttccaaatttttattttgttgtggcccagtcatgggcaccagagattaggaaatgactgtgcagaggcttgagggaatttgggaaaagacaaaaatattctaaaatgtgacactgctgatggctgcgcaattggtgagctttattacaagtaagcttttttgtttgtttgtttgtttgtttttgggggggatagagtgtcactctgttgcccaggctggagtgcaatggtgtgatcttggctcactgcaacctccgcctcctgggttcaagtgattctcctgcctcagcctcctgagtagctgggattacagggacatgctaccatgcctggataatttttgtatttttagtagagacggggtttcaccatgttggtcaggctggtgtcgaactcctgaccctgtgatccacccacctcagcctcccaaagtgctgggattacaggcatgagccaccgcgcctggccacaagtaactttttatatgaaatttccggtttcaattctgacatataaagaggtgggaagtcaccatttgtcctcacaacaagaataaagctgaacaaactgaaaaccaacaactcttcttatacggccagagaattgaggtcgctgccaccctgaaaactagaaagacaggcaaatgcacggagtcacagcttaccaggaacagaaactgctggagccagcacctgggaggagaacttaaatagtattgacagattactagaagctgagggtggcttggcttgagcattaaaaacgctctgagaaccagtcatggggggaatctcacactttcctaaatctgaccactagaaacccaacaaagttctcatggagaagatcagaaaaaatccccgaggattggcactgccaacttcagctacagtaaccaaaacagtatggagttggtgaaaaaatgtaaaacagactcatagatcaatggaaaagaaaacagagcccagaaatagacctacataaatataataaactgatctttgataaaggtgcaaagacaatttaacagagcaaggatggccttttcaacaaatggtgcgaaaacacctggacaaccacatgaaaaaataaataaatgtacatacagatcttataactttcacaagtggatcttataactacctgtaaggttcaaaaccacaggactcctaggagataacacaggagaaaagctaggtgaccttgggtttggtgatgatttcttagaaacagcattaaaagcgcaatccatggaagaaacaaaattgaaaagttgaacttcattacaattaaaaccttctgctctgtgaaagacactgttaagagaatgaaaaaacaagtcaagactgagagaaaatatttgcaaaatacagatctgatgaagggctggtgcccaaaataaatgaagaactcttcaaactcaataataagaaagtgaacaacccaatttaaaagtaggcaaaagatctgaacacctcactgaaaagatatacagataacaaataagtatatgaaagagacactcaaagtcatttgtcattagaaaattgcacatgaaaacaatgagataacagaacacacctattagagtggctaaaatctgtaaaaagtgacaatcccaaaagctgtcaaacaaacagagctacaggaactctcattcattgttggtggaaatgcaaaatggtacaatcactttggaaaattgtttgggagttttttttttcttttacaaagctaaacataatcttaccctataatcttgcaatggcagtttgacttatttagccaaatgagaggaaaacttatgttcacccaaaaacctgcacacaggtatttacagcagttttatttattattgtcaaaaactggaagcaaccaagacgcccttctcaacaagtgaatggataaacaaattgtggtgtatccatacaatggaatattagtcagtgatgaaaagaaatgagctatcaagctatgaaaagacataaagaaacattcaattcataatacctgaaagaagccagtctgaaaacctacatattgtatcattccaactgtaggacattctgagaaagtcaaaaagatagagatagtaaaatgatcagtggttgccaagggtgaaggagggaaaggagggatgaactagtgaggcacagggagttttcagcagtgaaactattacatgatactgtatttgggagtcatgacactgtaattttcaaaacccaaagaattgttttaaaaaaataagataaaagacaaaacacttaatgtgaactatagacttcagttgatgataattatcaatattggttcatccagtgtaacaaatgtaccacaatactgcaagatactaatgggggaaattgtgtattgaaggacagggaggcacatggaaactctctatagtagctgctcaatttatctgtaagcctagaactgttctataaagtaatatctattaatttttctaagttagaatgtgaaagctccaaattcaatttttggtggcatcctgatatcatgtggttaatacttggcattgagatgcaccaaactggagtcagagcagttgaagatttcaatgtctgtgccttcaccctctgtgcctggggatgcccctggaatccagatggcagatcagttaggtcgtagtggcatcagcactccagacagtgtaggttctagtaaggacagggtgaaatcaccttggagggcagaacttgctaaatacttggaaccacagatcaaaggagaaggagacagggaggaactgcaggctacagaatgagctccctgactgaaagataaaggcagcttcagagattttggcaaattttgtgagagaattaaatgtcagaaaaagaacttagatttcagtgcaaagtggtctatttaaaaagaaagagaaggaaggaaggaaaaggagggaaagagggagggagggaacttagatgaagactagaatatctgggaatgggcttaaaccatcaatcgtttccattaatgaccacatgctaactaattatagcacagagataccatactgtaacatcaagtacagttagcatgggggtaagaaagtgttccccaacctctccgttctcctctgaagacacattttcttctgaagaacagagatattgaatcttgcctttgggtaagtttgggcatccacatgaatgagctggggcacccaacaccagattacaccaggccacgaccttccctgctgccccttgcctgcttcagaggctgccccgctgcaggtgggggcctcagccccaggtctgatgttgtccatttgctttctcactgggcttctttccttgcactgacttccactccccaggactcagtgagtggccacatgggaaagacacaaactggccatgcccctttctctctgacacctcttgatgcctgcagaggtgagctccagacccactccatgagtagtgacttgagacttgctcacaatgatgtccctgtccaagagcagggactggcacttaatagccacacatgaaagctcagtgaaagaaggcatccaccacaaggtcctggaggaaaaagaattccactatggtccataacgttttagtcccaaaagatcccagattaggagatgtgaaaggcttttgaaagtggccattcttttaaagcattatgctggcagctgcactatgtttccccatcctggacatgtctggagggcactgtctacagccatacccacctccccacccaggacagtgcagcagctttaatttgggggatgccagtgggcaaggaaggggtgaaccatgaaagctgaacaggagaaagcaggtggaagaggggcaacagggtggaaatagagaaaataaaggtgggtagagaatggggggactcagggggagagagagagagagggagagagagatctagccactaaggaaggaaaaagtccagaagagaacacttgtctgcttcagtaaaataatttacacctaaccaggtgcaagggcactgcaggtcgtgggtggcatgccctggtcatgctgtgatgtttaggggccatgacatctaccctttgaatccaaatcatcaaatagagagggaactctgtccctatctagctggcaatgccttgcgattttaccttttagatctggcagctctccacatctgctcactttgtgggaggcagctcttgacgcaccaaatcaggatgattcaaaaatcagagccttggagacttcactggaaggcttggacagtgggaggtggtggcatccggagggtggagtccaagaggtagcagcgctgaggctccacacaccctcaggaggatggtaaggggcaatctcttggtgagcacctaacttccccaggaacctctgcctaggtggaaatgggccccacgcctagcttttctctggacaggccctagccagggatccagggtaccagttgagtcctaggcaatgcaaatgcctgtgtgctgaccttgtggtgactggaaggaagcaccatgatccttccacttggaactggacttgcaaagacgatggctcctactgctttcaatttccttggactttcgcaatcagatttagccttttggaatgtgaacatgactcttctgggtcaccccaggtatggggtggccttggatctgctggtcctccccaggcctcaaggactggctgatattcatcatctcggttggtgtcaccgcactcacaatccccagcaaagatcccccaaagtgtcctgactagaaacatattcctcaacttcctctcagctcgtggtagccattcttctgttagtgtaggctgcgtgtgggaggctggtggtgggtagggtgggagcctagagaaggaagaggaacggtagccaaaaaggagcagagaaggaggaggaggcaggaagtatagaaagctggagggagctggggaaaatgggtgtgggggtagtgtgaggaagacagggagcaggagagagaggggactggaaacagaaggagaggaggaggagaaagaggaggagaagaaggcagaataagaagagcagaaattccagcatatcccaaatcttgttccagaaatggttatcagtgccccatggataaagggaaaaggaaatttgcaaagaaaaagaaagaaaccccagcgggtagagggtctcggcagaatgtttatttcagagcaggaaactctggcaacccaggcagaactgttggctttagtggaggcctaaatatagctcttctctgttcctaatcctgaaaggtgcttaatctcattctctgagatagaaacctaaagagaagggcagagagaggtaagtctggggtgactcctcctattgtagattaaaggtactcaagtcctgtgtgacaaagagaaaaaaatacctgaaaaggaaattctggtgactatggaggctgagaattcacttgtcaaatgctcataactgagagtattctcaacagctggttccatgggttaatggtgagcaccctggactctgaatcaagcgatccgagttcaaatctcggtggtaccttggtgtctgctggccttttactctggagccagaagccactttgggaagcaaactccaccctcaaagacagagtgaaagggatgtggtttacatttgcccttcgtaccaagtcctgggttaaagaagagaaaggaaggtttgggtcccggggaaggaagctctgctgctgcaaatcccctagtccctcctgctccggcctcgcaatgcgtcccctgcaatgtccctcctcctctcccgtgtccctcctgctccggcctcgcaatgcgtcccctacgatgtccctcctcctctcccttttcctcctcagtggtctgggtcccagaaaccggcttcttgcagtggcctgctccacagggaaattgcccaaacatcccatcggagtcaccaatcctggtcccagtcctgggcgagcctcccggccccctgcaatcggaggcccggaccccgcagccagcgtcccagcaaccgaacaagtccccatcccctctcagggcgaccctgggcctcggggtgagaggtttcctacactaaaagggctgcggcccctcagtgctagaccccgagattcctttcactcgggaaatctcgtaatcgcatccattgtctttttggtaagtaaacggtgacgtgagaaattttgatggggttagctcagtcattggtgattatgtctcagtttagggtagatggtttgagacctaacttagaagtaacactgttttattcggatggcccatcctcttccgaatgttaatttactctgttcttcatattcagatttccatgcctaatttctagctcctacgtctctattgcgggacctaaaagtcgctgtttcactaagctttggaacccgactccaggaaatctcattctttcgtcccaaaatttcaaccgtaaagagaaatccgcgcggcggcctcttcaagcgcccgggccgggagcgcgggttctgaccttcggtcgccgggccggtctcccgcagcaccacgggtaagaggagcctgagcagctcggagggatgagtgcgggacggtgggggctccccctcttcctgccagtaccttgccccaaggagaagatgccttaggacgcgacagatgaaaaatcttttcttctgcttggcggaacactttggatgcggcttatggtgggtcttgagagcaagctaagatgtcccgccagacgctcaggaccatcgctctgattttcatattttgcaaatatgaaaattttcagcggttacgaaggactgaaaaacaccgcagtctttgaggggctcagtttggagggcgtgcggaggtgtggggtgggagacgggagagaggtgccttgttggctccttggagtggactgataggaaggaaaacacacaaattccatttccccttgcaggctggactgcagggcctaggatggaaaactgggcagtcaaagagcaacaatatgtagaggttgactgcatgcattgaaaattgttatccctcacacctgtaatcccgcattttgggaggccgaggcagtcggatcacgaggtcgggagatgatcatcttggccaacatggtgaaaccccgtctctactaaaatacaaaaattagccgggcgtcttggcgcgtgcctgtaatcccagctactcgggaggctgagacaaggcaatcgtttgaacctgggaggcggaggttgcagtgagctgaagctgagatggcgccactgcactccagcctggcgacagaacaagactccgtcgcaaaaaaaaaaagaaaagaaaagaaagaaggaaaaaaggaaggaaggaagaaggaaggaaggaagaaaacaaaattgttatccctagaaaaaagtgtaggggggaccagaacactgctgttgttgctgttcaccaccagctttagagcatatgtaactggtaactgtacagtgcatcaaaaatccttcctgtttacaaccaattatcacaactagctacagatttctttgttccttctccactcccactgcttcacttgactaaacttaaaggaaaaaaaattgtttttacatatgatattgtttaaattgatcctcagcccgtcctcctcaagtagctgggaccacaggtgtacaacacggtgcctagctaattttgtagagacaggggttttgccatgttggccaggctggtctcgaactcctggactcaagtgatctgcctgcctgggcctcccaaattgctgggattacgtgctggcctccatgcccagccatcatttgtattttgaatttaaatattttatagtcataagtatcactcttcaaagattctgagttttgtagcatgtatatggtgaggttcaggacacactactccaaaatataacaccttggggtattgaatattttatgctaaaggaatttgagaaaacaacaaaagcaggaaggtcactgtcaccctccccctgcccttcttccccaaagcagatcataaggctctcatgtgagaggtgctctctctgtacccagaggaaagatgcattgctgtgtctgaagacacagcgacacagagtctgagcacacaggcctggctacatttcccccagtttattaccattagatcatactcctttcatcatatctcacttctctatgactatccactagtcatcaaacataccgttaaaaaaaaacaacttgaagtttagctgtttcttcaggtcttcatttctttaggaaggctcttcttctatcatgtaaaacttacattaaataactagatatgctcttctcttgttagtctgtcttttgctataaggttctcagcagtgaacctaggctgggtgaggaagagtcatatttcctcccttacatgtacaaaatgtcttccactgtaaaactgtaaaaattttattgaggcaggtttgaagcaagaaattgaatcattattcccctttggatgaactgaacagatgagctaacaaacccccagttcctcccagatagaaatacttctctagctcattccctgaatctccttgagggtcaaacctgctggagattgaggggccttcctgggacctcccagcccaggagattactgctggtgagaagattgctgcagtttccctgggagggtgcacagccactggaaagtatcactgctgtaacttcaatacaacaaattgtcatcatatctgctcttttggtttatttatttttttggagatggagtctcactctatcacccgggctagactgcagtggcacaatcgcagctcactgcaacctctgcctcctgggttcaagtgattcttctgcctcagcctcccaagcaattgggattacaggtgcactgccatgccaggctaatttttgtatttttagtagagatggagtttctccatgagggccaggctagtctcgaactgctgtcctcaggtgctctgcccactcgacctcccaaagtgctgggattataggcatgagcccttgcacctggtcacatctgctctttgtgcagtgttgcaggcataatacaagagctaacatgcaaataagtaacatatgaacactcatcaactgtgcctgacatgccaagtgccacatgtcaggcacagacaatgagtgtgcataattacttatttagtctttaccacaggccaaggtcacaccatcatctttatcttccatatgagacaactgagatgcagagatgttaagttacctgcccagggtcactctggtcagatttctttcactgtcatactttttctatgtcaagtttttctcactgtcataattttttccagggcactttcattaggagcaatataaacacagtggttctgagaatgtcttctggagctaggctgccttcacttcaaattcttgctttcacatcctccttccctggctaagtgaccctgagcactgcatcttgcttccaacctccaagcttcccttgtccattcctggacataagccaggctaaatatgagaggagtttagttccaagtctaagtgtgaaacaaagatgatagccctttcccgagacaaacctcttcctttcttggggatcagacctccttagcaaagttaacaaattaggcacgagattggaaattatggctcaggagctatgaagccagaagccacaagattcctaagctccccaattgtgcctatagataacatcattagtgtcaaacctaagattggtgttcaaggtatttttcagaccctgccttatgatggactagctggcacacccagaccggtaaactggctcatctggtcctgtggcccccactcagggactgactcagtgcaggaagacaagctctgactccctgtgatttttatccccaacccaaccaatcagctttccccattccctagccccttgcctgccaaactatcctaaaaaaaaaaaaaaaaaaaaagtgtcctctgaatttggggggagacagatttgagtaataataaacctctgtcctggtcacttagctgtctctgcatttattagattctttctctattgcaggaagcctgcttttctcagctccattggcttttctgggcaaccagcaagataaactcaccagttacattaataaaagagaaacacaaatagtacatatgcttgaaaagaagtgtaagtctgtatatttcttttgaagaaacaggaaaggaggaggaataatatgacaggcaacacactgtcctaaatattttcatgattctcctgcctccccatatccttcttatcccaacaactgctccctagaaacctccaacttaaacacaatcctgccagaactaggtttgtccttctcttgcattttcctctcacttgccccacaccccttccaaatctgttctttcacttccaggtcattgagtttttccatttaaaaatatgaaagatacagaaagaagaagataaccagtcatccatattcccaccacctggaattaagtactgttcacatatgtacatatttttcttccaaatcattttaaagttactctcattttttttaaattatacatgcttagcataaaccataacactaatacagaaaaagtacagatatgtaaaatttctgatcaccataagttcaaaataacttttgttaacattagggcaacactgattgaatcatgttcttctggtatatctacagagagaagaatgtatattttagctagactgtccccccaacgcccctgcaaaagaaaaaacagaacaataaatatatatatatatatgagctatatattatatatatacatatatataggagctattatatagatacatatataggagctatctattatatatatacatatatataggagctaaatattatatatatacatatacatatatatatatacatatatatatatatatgtatatatatatatatgcttttctaatattgagcttagactctatttttattttacaaatattccatttgggtccggcgcggtggctcacgcatgtaatcccagcacttcgggaagccaaggcgggtggatcacgaggtcaggagatcgagaccatcctgggtaacacagtgaaacctcatctctactaaaaatacaaaaaattagccgggcgcggtggcgtgcgcctgttgttccagctactcagaaggctgaggcgagagaatggcgtgaacccgggaggcggagcttgcagtaagccgagatggcgccgctgcactccagcctgggcaacagagcgagactccgtctcaaaaaaaaaaaaaaaaaaaaaaacaaaagcaaaaacgaaaaaacaaaaaacaaaaacgaaaaaacaaaaaacaaaaaacaaaaaacaaatattccatttaatggtgcatgaatttaactgaagacaaagagacagaaacagaaacgaaggaattcctgaactctcaatcacatttagagagacgcttttctaaaggaatcctctaaagctaaacataagttaaattaagtagaatgcattatgatttgcagtgtttgtttgtttgtttttgagatggagttcttgttttgttttgttttgtttttctctgttgcccaggctggagtgcagtggctcgatctcagctcactgcaacctccgcctcccaggttcaagcaattctcctgcctcagcctcccaagtagctgggattacaggcgtgtgccaccatacccagctaatttttgtatttttagtagagatggggtttcactatgttggccaggatggactcgatctcttgaccttgtgatctgcctgcctcagcctcccaaagtgctaggattacaggcatgaagcactgtgcccggcctttttctttttcttttgttttctttttctttttctttttttttttttttagagcagcatcacttgctctgtcacccaggctggagtgtagtggcgcgatctccacatgctacaacctccactcccaggttcaagagattctcctgcctcagcctcctgagtagctgggattacaggcgtctacatcacacccagctaattttttttgtatttttagtagagatggggtttctccatgttggccaggctggtttcaaactcctgacctcaggtgatccgcctgcctcagcctcccaaagtgcaaggattacaggcgtgagccaccacgtctggcctgcagtggttttcttactactttttacaatcaaattgattaaggcattggttgaatatggtacaatacatccatttcaagtttgatgacatgtctactactccagaaggtcctcttgtgccctttgcagtcagtcccctcgactccctgaccccagcaattaatgatgtattttctgccactatacaggttagtttcacctgttccagaaattcaccttgatggcaccacacagaatgcactcttttgagattcacccatgttatctcatgtttccataatttgtcccatcttactgagggtggtattccattggatgaatatatcacaaaaggtccattcacctcttgatacatatgaactgtttccagtttggggactattgtaaacaaagctgctaagaacaagttctttttgttaatatttgttttgtaaattccgtttgtcattctttagtattaacttattttgtaaaaggacgtaatcttcataagtgcaaaattcattcaaattttacagaggcctgaagcagaagcctacacaatttcctttgttatatttcataattaaggggaaaaaaactttatctgggatgttgtttcctatcagcaaatccttaatgtaagccatacaggatgctagctgtactattagactatcttctgtaatctgtgcaataactctaagaagtacttcgtcttattattttcctgtaacactttccaacttgaagcctagcaaattgaaggacctggccccaggtcaaacagaaggcaagcggcagcgccagtactggaagaaggccttcccaaaggcagacagaagctcacgtctttgtcagaacctcggtatttctgatgcgcctggaagccaatatccaagccgttctcagccactggattggtgggctgctttgctcagaaactcctcgatcaggaatcccaagcatacgttagtgatgacggtcccaaaacaagggacatttcttaaccattctaaaaacccgtttgctcattagtaacgcaatgaaagttgctttcgtcttggttcatatattttatatttgagcaaggcaatgtccgctgctggggttagaagtaaatggctcgtcttcatcaaactagatcagtccgtaggacgtatggcttccactcgcagtgtcctgaacactggctgggcttcctgtgcgttctagccggttttctttggagccgcgggtttctgcaccgcaccctagtcgggatggcagaggcttctcggaacacgcggatctatgagtgcagtccccggggtagccaccagggaacgccataggctttcccgctgtgttcctccttgccttttccgtttgggccaggtagtttctattgaccaggacattacagatcagaagtgggtggggtcagaaaacacaccctgggagaggctggcaaaatgcccagaaccgccatcactaggactggggttttcttctgtagtggaattctcgtgttcatgtagtgcagggaggatcgcagcgcatttccgccaagacaagtgagactgcggttctgacctgcgggcctcgatgaattgcgttaggacacctgggcgctggcagagccgttctcctacacaaagcaagcgtgttatgtctacaaccgaacggggacactaagagccccaaaggccctgctttcatcccaaagaagagtgcctgtctgcgtagtttccacctggctctatgaggtgagaactgattcctcgctagcacagaaatcctgaaacagaggctgtgtaaaaggtgacaggggcctaggggaaaacacgaagattttcacagagcgtgagaccccaagagactggagaccatggatcaatttttgcaataagcagccttatgttcaaagggaaaagctatgcagccttcgcgctagttaacttgtgataaacaggctcacaacggctgacgcttgttccttctccagcgaggacaacgacatgccacttctgttccccagccatccaactgtaaaaataacatgacaccacccatattatgcactactaaaagtatcccttcacatacaatctgcgttttccagcacaaaattcagaggacagcgcgaacgcagtcccccactaccacaaattatgcagtcgagtttcccacatttggggaaacggcaggggtcagcacatccggagtgcaatggataagcctctccctgggaaaaccaccttcgtgatcatcgtatctcccctgccaggtaagtatgagatcatacgcctccgccctgccacagctccatacgcctcaccccttacacgcacggtcacttcccacgcgcaaccccccaccgccccccacccccacccccagccctcctagccctgacacacagctgggactatcacgtccaaccggcggtcctggacttgctcccacagcaggagaaatcctccgtggcgaagcagcagcccctgagatgcctcatctacacaggaatcgccctatccgtgatgtcaccgacagcacctttcccggtccggctctgctcttctgccccaccctctgccacctcagccgatgaacccgctgcgggagccggcggaggaagtgacgcctgcctctccctcttttccctcccatccacgcccctggtctctcccagagaagtaggttcttagtctgtgatgccaaggacccctttggcggccagctggagcctgtgcgctcttcttcaaataatgtcttttaatgcgcaaactagaaagttcaggattacaaagaaaactggttcttttcacatacggttatccttgtgatgtagcattccgcttgacattggaagtcgttcgatatcagagagaaaccatatctacgaaactagagaggctgctcagatgactacaaaccagccattcttacttgttttatcactgggagtgttataaagatggtcgtccagtttcatgattcttgcagggttttttcaaatacagcaatgtacaaaaatgtgctgctccagcagagcacactggacacgcagacatggtgccggagtttgccatctcttccactgccttctctagaccttggcgcttacctcatgttaacagtttatatgctgcaaagacagaaacaaagtcatccaaatttggcaaaaatatttgggggaaattttatttcaggtgtttaactgattacttttaatatgtagactacaacaccaaactctgacaatactccacagacttattaatggtttccacccccctctctgcaaatctatcaggcaagtttttcctgcccttcactttcatataagctgagtcatacagtgtgtagtgggttttgtggggagtgttactgcccaacatgttcaccttgcctgctgcctagacagagccaatttttcgacacaggggaattgcaataaagacctgcactttttatttggtggttgggggccagtgagttgagagttgtgattggtcaggtcggagatgaagtcacagggagctgaagctgtggtcttctgctgggtcagttcctgcgtgggggccacaagaccagatgagccaggttatcagtctagctggtgccagctgatccactgagtgcagggtcggcaaaatatctcaagcactgatcttaggttttccaataacgatgtgatctccaggaacaatttggggaggtttagaatcttgcagccagaggctacatgactcctaaaccataatttctaatctcagggctactttgttagtcctgcaaaggcagtctagtccccaggcaggaagggggtttgctttgggaaaatgatattatcatctttgtttcacagctaaaccataaactaatttcctcccaaagttatttcggcctgtgcccagcaatcaacaaggacagcttggacgttagaaacaagatggaatcagttaggtcagatctctttcactgtgataattgtcccagttgtaacttttgcaaaggcggtttcagaagcagaggcataggtttgacttctttcactcagtcttatgtctatgaatttttcatgttattcatatggttatttgtttctatgtgtattcctttgtaggaatatacactaacttatttatttcttctgctattgttgagcatgttgacctaaaagaaagaggctgaagcacaaaatataatttagagtttacctgagccaacatgaagagagctgcctggaagactcacactcaaggaaccttggatctgagctccctttgatctttgtcacaagcaggtatttaaaggtcaaaagcagggacagacagtgggctgacagaaaggtgcctgtcaggagttctcattggtttacagaaataacattgattggtgattggctatatgttgttaagttatagggtatgggggtacagggattggtgtggcattattaggttaatttacagctacttgaggcaatagcaagcagtttcaacagatgaatacatagctcagtgcagctcaaaaggaaggagcagaaagtggttgctgtctcgatttaacctctctctgggcctgatcatctgagagggctcacattcctcagataaaacatttttaaaaaactttcttcttgaaagcattgatgatcaaaagctcattcaaggtgtccctctttgccagaaaggcttattcctggatagtcctgtcccaggcaggggacaggggaggaaagaagccacctcactgaggaatttttaagaatgcccaaaagtccaattgaaagggcattacaaccaggcacggtggctcacatctgtaatcccagcacttcaggaggccaagatgggtggattgcttgagtccaggagttcgagaccagcctaggcaacatggcaaaaccccatctctacaaaaaacacaaaaaatagccaggtgtagtggcacacaccttagtcccagctactcaggaggctgatgtaggaggattgcttgagcctgggagttcaaggctgcactgagctaagatcacaccactgcactccagcccaggtgacagagtgagactcggtctcaaaaaaaaaaaaaaaaaaaaaaagagagacagagaggcctcagttaagtctgcagcttctgtcacttgttgaatcatctctagtcttcagaataccatgaaattagttttctcagaagtaaaacgatgagaaatacataacaataatgacattgcacttcatcattccatttcctaagacatttatagggccatggatggtgatcttttcaagagacaaaaataaacgcgggtgcagaacaggtaagtgcactataatttgagtacatcagcttttgggcattaaaatcgtgggtcagaaatttagagcaagagggcaggctggatcctgatagcaggagagtgtgtgtgtgtgtgtgtgtgtgtgtgtgtgtgttttgagacggaatctcactctgtcgcccatgctggagtgcagtggcacaatctcggctcactgcaagctccgcctcccaggttgacgccacactgagattccctagtagctgggactacaggcgcctgccaccatgcccggctaattttttgtatttttagtagagacggggtttcaccgtgttagccagggtggtcgcgatctcctgaccttgtgatctgcccgcctctgcctcccaaagtgctgggattacaggcttgagccaccgcgactgtccgagtgtttttcttttaactttccagtagcatcatggtgtttaccactgttatttcagagtgaagtgacaattttgttgtttggttggttttgtactttttatttttattataattactttttaagtcaaggactctgtctcccaggctggagtgcagtggcaaggtcacagctcagtgcagccttgacctctagacctccaaggctcaatggctcagcctcccaagcagctgggactacaggcacacatcaccacacccagcttatttattttttgagacagggtctcactctgttatccaggctggagtgcagtgacatcatcagggttcactgcaggctcgaactcctgagctcaagtcatcctcttacctcatgctcctgagtagctggactacaggtggacaccaccacacccagctaatttgtatatattttacaaagtcagtgtttcaccattttgcccaggctagtctcaaactcctgggctcaagtaaccctcctgccttggcctcccaaagtgctgggattacaggcagttattttgacaatacgattatgatggttaaactgagacgtgtgccaggaaggttagggtgaatcagacagattagataaacaggttttgcttgatatgaccctgagttgcatcgtgagtgcaatcaggaggaatacaggtgaaatttagcacaggatgtaccaatgggtcattacggtcaaaagtggtttgtggttctgagtggcaaacctggaaccttgtcaaatttcccacagaggtaatggtttgtgagattctgatcagagaattatccctccctgctgtaatcaaattagttagggacagtaaaacagaaatctgatcataagtattttgctatgtatgtatgtatatgtatatacacatacacacaataggactagtgtggcatatcttaagagaatatgcatatagggtgattttaccaaaaccaccaagagacaacccctacaacttaaaggagccctaatggtgtgtgtattccagtcaacaaaaaagagactaactctttcaggtgcagtgagcactggaattgtaactgattatacaggccagtatcttgggtgaaagcggactaccacagatgtcagctacttgccatctctgtcaggaagattgagttacctttaagtgaaaatctcctgacagatgttcactctggcagggttgccttttacaagagaaacatgaatccgtgtgtcaacgcacgtaagtttaatggcacagattggtcagtaatacctgttgtgagtcaggtgcagtggcccatgcctgtggtcccaactatttggaaggttgaagcagaaggatggcttgaacccaggagttcaaggctacattgagtcatgattgtgccactgcattctggcttggggaatagaatgggatcccatctcaaaaaaatgtataaaataataataatacctgatgtggtcccttccaacagtcttggggggaatattttatttggtgttgtttctagtaaacaacatctccaggttataggccgtgatttttagtattttcatctcccaggagtgcattatgaaaggaatcctttattaatgtggagttcttagtaagttttgagagatcttagcagtaatggagaaagtcacctttaagaagtgcagattcataagcgccttcatctaaccactgcatgggtcttccgttattatttcaaagagagggagtgtggacattttccagaaccagtgggagatccttggccaagaaaggttaaaaacttctgttagctttgccaactgagtttttattgtgtcattagtacattccatcggcccagaggattatgggtgacaggcacaatggaaatgttgggacataggcaaaacattacaaatggatccaattacctgaccaatgaagtgtgttcctcagttgctatggcattcagatggcactccccatgaggaattaccttttcttttctttttttttttttttttttgagatggagactagctctattggaaggctggagtgcagtggcacgatctcagctcactgcaacttccgcctcccagattcaagcaattctcctgcctcagcctcctgagtagctgggactacaggtgtgcaccaccacgcctggctaatttttgtatttttagtagagacggggtttcaccatgttggccaggatggtctcgatctcttgacctcgtgatctgcccaccttggcctcccaaagtgctgggattacaggggtgagccactacgcccagccaggaattaccttttctaatcacaatctacctactacttgggctgtggctcattggcatggaaatgctcaccccagtgagcacgtacaaattaacaccagaaagtatctgtgaccctgagatggagacagctggataaagtctaactgccatgtctcgaagggtcctaaagttaaaatgtccttgtgacccatgaaggggctttccagggtgatgtttgggacaaacagtaccacaagaataaaccttttctgcaatcataggcaatgattttcaataccattgctttccccatgctaacattttatctgatttccaatgaggcagcttatgaagtactgtattcagggtaattgaagcctaaggggtggatcagtgtatcattgggcccataccataagcctgtttctggaagaaacttgttccctttatccttccagagatccctctcctgcttaggagctcccacttacgcttctttttttttttgctagagtctagctgtgttacccaggctggagtgcagtggtgcaatcttggctcactgcaaactctgcctcccaggttcaagcaattctcgtgcctctgcctctcaagtagcaggaattgtaggcatgtgtcaccacaccagctaatttttgtatttttagtagaaacagggtttcatcatgttggccaggctggtctcaaactcctcacctcaagtgatccaccagcctgggccgcccaaagtgctgggattacaggcatgagccaccatgtccagcccacttttacttctaatgaagtcttcaatgggtcataagtcagcaaggtcatttcgagaagttctgtgtctgatgccaccttcagaactgcattcttagctgcagcatcagcaaaatgattgtccttgctctccggaatatctagttttgaatgaccaggaattttgatgatggccaaagataagggttttcaaattgcttctaagagatcagagatttattggtcatttttgatggcttgacctgatgaaatcagatacctatgttgcttctaaagcattccaaaatcatcacctactccaaatgcatctctgctcccagtgtaaatgttaggctgaggtggaaggattgattgagcccaggagttcattcaggtccagcctggaaaacacagcaagatgtcctctctacaaaaaaaaaaaaaaaaaaatcaaagaattagctgggcattgtggcatgcacctgtggtcccagctactcgggaggctgaggtgggaggattgctagagctgagaggttgaggatgtggtgggccatgatggagccactgcattccagcctgggtgacagagtgagaccctgtctcaataaatcaataaataaatcttaaccatttaaaatatcaatgacagatttgtttggccttttaagtgcattgctgaattctccaatctacatattggggaacaacctgggtaatggcaacatggaggtatttggcaaaaatgcagaccctttcattgtctgcttctgtctgtttttaaaaaccctctaaaggattattccaattcaccctttccaaccatttagtggccctgccttcttacaccaacatgtgaattaattgataaagatcagaatatccaggctcaaaagtttggacaattaagtcaaattttctcctaaaccctataggatcttggaggttgcttttgaattagaaagggaaaattcagctgggtgcagtggctcacgcctgtcatcccagcactttgggaggccaaggcgggtggatcacaaggtcaggagttcaagaccagtctggccaagatggtgaaaccccctctctactaaaaatacaaaaaaattagccaggcatggtggtgggcacctgtaatcccagccacttgggaggctgaggcagagaattgcttgaacccgggaggcggaggttgcactgagcagagaaaaaaaaaaagaaagaaagaaagaaggggaaaattcatgtaaattttcatcagggaagtcttttttttttttttttttttttttgatacagagtcttgctgtgtcacccaggctgagtgcaatggcatagtcttggctcactgcaacctccacttcccaagttcaagagattctcctgcctcagcctcccgagtagctgggattgcagtcatgtgccaccatgactggctaatttttgtatttttagtatagatggggtttcaccatgttgtccaggctgctctcaaactcctgacctcatgatctgcctgcctagtcctcccaatgtgctgggattacacgcaagagccactgcgcccagcccagggaagtctttttataatattcttaattcacattttggtgaagcagtatacagaatggtaggctcccctcttcctgtgggttttaccttgaaaggggctgtcagaacagaagtttcagggaaggggccagagccctggggactttcctcaggtgatggtgatggaagaagaggcaaggcaggaccagagggctcaggtaagggagactatgcaggtgcaggggcaggaggagaagcagcagttggaggcgaaagagacaaagcctcctcaatatttctcaattcagaaaacgtgtcagatgacttccttcagcttacttcctcactggaggcaattttctcagttcttttagaaatttctaggtatcattggaagtatgtctcccatttaatttggttctaaaaccaaattttttggccaggcgcggtggctcatgcctgtaattccagcactttgggaggctgaggtgggtggatcacgaggtcatgagatggagaccatcttggccaacatggtgaaaccctgcctctactaaaaatacaaaaattagctgggcatgctggcgtgtccctttagtcccagctgtttgggaggctgaggcaggagaatcgcttgaacctgggaggcggaggttgcagtgagccgagatcatgccgctgccttccagcctgggtgacacagcaagactccatcaaaaaaacaaaaaacaaaaaaacaaaaacaaaaattttccaattgtgcacactaataaattattttaagcatttcaaaagatcccaattttcttcattctgcttatgacttaggaaatgaccaggaaatggttaggtgggtccagtttcttggatatttacaagaggatgcttcataagtgttatacataaacccagctggtgtttctaaaggtggttgtttcttcacagtgtgctgaattttgaagcttgatttcccataattcaggagcttttcagatgaccaaggcctgcgatgtgttttgggtcacagtgtggtgcttatgaagtcactcctacagataacaccggagttgtgtgtcactgtctcagtggttccactgtttctaaccaccaggtggccacagagtcccacatatatcctcccagaagagcaggaaagggggttgataaaagtgttcttctgatgggaagtgtcctataaggccaccttcacatggtgactaatgaccccaacacctctgcaacatccccgatcacttggagcacctgaatggatcagcgggagcagatcacttcttttcttcagggcaggggaacacacctccatgcactttccagttaagaactaacaggaattagtcacaaatgaaaacctaagtccaaatgttcaaaacaacatgctacataaaacaaaaccaccagggcctacctgccaataccttgacccagaacttcctgctgaggaatagaggcagaaaaggcagaagctctctggggagctctttgcctgactgtgacccaaaccttctgtcctgatgcagaggtggaaaaggcagttatttccccctgaaacacaaatctcttacccacagggtaaagacagaaaacctctgttctagaaagggagagctgaaaaggacactcaagcaaactccaagacttcaatcaaccagtgtttctctcagagtcagtactcgaaggcttcagagctggccaggcacccagtccaggaggaatgtggtgtgatctgagagatgaaaatacatgcccccttatagactaagacagactgtaaggttaaggaaacaaaagttagctacttgtccagggttcagggctcatctggcatggcaacttcctgaattcctatggctacaggaaaaaccacactcttgctaaactccttaacaataggagctagcaagcaaattgtcaaaatcttcccagcccttctcaactggatttacaagccagatcactagagctctgatgggacagaggagtggccttccattctttcctaataagcaactgcagatatcaagccagtttcagccatgttacagggactgcacacaaaccaacttcatgtccagtagttcaccttttgatataaagagccaatttctgccttattttatgctaaaatcccttccccatctgtgaagatggggtgcatgttacatatatgtttacccattgcacatgagctcaatactcctcagaaatggtgtttccccaaacctactgaatatgtatgactctattgtgtgatacacaccctgtgaggcacaaaaaccaacctgccctctctctctgtctctgaagagaaagtgcctcttcaaagacacacaccggagactgtcacttcctggactgcaaacttatatcaccaataaaattcttactactatttagccaccctggaggcctttgagaggacagtcagatggtcagagatgagtcagtctgaatcctgctcccagggccaaaaacattgacatagaaggaaggcgcttaagcacaaaatatgatttaaagagtttgtttgagccaatgtgaatgtagttgcccggaaggctcagacccaaacaatattggatatcggttctatttggcctttgttacaagcaggtttgtaaagaccaaaaagggagtcagggagttggctggtaaaaagttgcttgtcaggaactcccagtggtttacagaaataacattgattagctatacattgttcagctacagggagtgagagatggtgtccagagcagcatgtttaggttactttatagctaactgtggcaatagcaagcagtttcagtggatgcatacatagctcaaaagtggggaagtggccggtggtggtggctcatgcctgtaattccaacactttgggaggccgaggttggcggatcacctgaggttaggagtttgagaccagcctggccaacatgaggaaatcccatctctactaaaaaaaaaaaaggcaggcgtggtggttcgcgacgttagtcccagcaactcgggaggctgtggcaggagaattgcttgaacctggctggaggaggttgcagtgggccaagatcctgccactgaactccaacctgggcaacagagtgagactccatctcaatacaataaaaaaaatattttttaacttaaaaaaatttagaaagcaggaagtaggatgtggttgctctctcattttaatgcctagctttaggcatgctaaattgaaagcactcattttcctcacatgaaaaattcttttcttttctttctttcttttttttttttttttttttggagacacactctcactgtgccacccatgctaaagtgaagtggcatgatctctgctcactgcaacctccacctccagggatcaagcaattctcatgcctcagcctcccgagtagctgggattacaggcgctaggcaccatgcctggctaatttttgaattttagtagagatggggtttcaccatgttggccaggctggtctcgaactcctgacctcagatgatccacccgcctcagcatcacaaagtgctaggattacaggtgtgagccaccatgcccagccaagaccattaatttaatctatagctaaatctattcgtttttcatgttacaaattcaacaagaaaaattttccctaatgaaacatcacatttaaagctaagtagaaaaaaaatgtaatagtgccttgctgtgtcatccaggtgagagtgcactgatgtaaccacagctgaccagcctagaactctgggctcaggcagtcctcccagctcagcccgccttctaattttttagagacggcatcttgccctgttgcccaggctggtctccaactccttgcctaaagcattcctcccacctcagcctcctgattttctgggattacaggtgtgagtcaaccagcctggcattgcaggaaaaaaaaagcccataaattattctttattttattttattttgagttgaggtcttactctgtcacccaggctggagtgtggtgttacaatcatagttcactgcagcctggatctcctgggctcaagcgatcctcctgcctcagcctcccaagcagctgagactacagacatgagccactgtgctggctagtttttttaaattagttcattttttaaaatttgtagagacaggggtctcaccatgtttcccaggctggtatcaaactcctggcttcaatccttcttctctcctcagctgcctaaaatgctaagattacaggtgtgagccaccacaccctgcttaatttccatattttaattttatatatgtaattattactgtctttaagataattggggcagtaatctctttaaagctttagggacttaatttatctattcactccactggaagagtatgacaattggtttcataagaaaaaaatttataaattagaaaatttctttccaccaatctagggggcattcaaaagcaaataattgcgttaagtaacatcatttaaggtgaaaacagatgcagtggtatctattaatgcttatcagtaagggaaacaaactgaaaaaatgaacatcattagatccttggaaaaccctcattgctgaaaatctgagtgattctgggatacccttttgagtctggcagggcattctctttccggagcatataaaagtgagtaaatcattttttttaatccattttcattaagagctgaacttccttaattttctggagattattaaatttgatttgtggccaggagcagtggcttacgcatgtaatcctagcactttgggaggccaaggtgggcagatcacttgagttcaggagttcaaggccagcctggccaacgtggcgaaaccccatctctactaaaaatacaaaaattagccaggcatggtgttgcatccctgtaatcccagctactcaggaggctgatgcacaagaatcgcttgaacccgggaggccaaggctgcagtgagccaagatcgtgccactgcactccagccttggtgacagagcatgactctgtcttaagcaaaaaaaattttgatttgtagagtttagagaagtgcttatgttgctgactccattgcttatttgtgatcatataaatctcttttctcctttctgtagtgtgatttaaacgtaatccttaaaggacatatatttcagctggttagagttttttagctggtagaaaactgagtgtatgaatcaaagaaaactgctcctttcatgctacagacttagttttatttctgtactaagatttcttttaggtatagtaatctgttaaagccaagagctcctatggaatgaagttcagtggcgggttacggggggcattgagtagtaagatcatctttataatagagatgccactcttgcaaatattgacagctattgagcccaaaaaattgttaccaaacattggaaagacaagatatgagcaacttctcattgctgcagtctcaaatatcaggaaataccattatcctcaggacaatgaacagaccatcaaaagagactcacagaccagatcagctctcatatatcaccaaacagggactggatccttgtcaaacaccacctaacagagattgtccccagaaattcacttcataacatcaaaaccagaaacccacactgatgccactgatggcagaaaacagtgatggaagaaagagagagagggagatagagaaaggaaggacttgctcaatgaccatacttagtatataaaaagcaaaacagctcaacttctgctcatgaaaacaagaaccaagggaacaagagccaatatctctaaggatccaggtctgcaccaggggcctgttaggtgcaggattctgttggctccaatgatgggtgtcagatggattaatttttatggacatagcctctgaaagaaatccgtcgaggctaataatacggagacacttgtctgcatgctcattctccattaatatagaaggaaactggcattagattgttttcatcaaataaaagtaaaatcaagatttataaagagaagaggaaaggggaggagaaaaaaaatgactgggaccattgtgattttgctccctttggataagcaacttggcagaaagctatcaaagaggtcactgtgacctgtcttctctggaccaatgtgacttggtcatcacaggaaacaattacaggctgggcacagtggctcatgcctgtaatatcaacactttgggaggctgaggtgggtggatctcttgagctcacaagttggagagcagcctgggcaacatgatgaaactctgtctgtacaaaaaatacaaaatttagccaggcatggtggtgtatgctagtagtcccagctactcaggagtctgaggtgggaggatcacctgagcctggggaggttgaagctgctgtgaaccatgattaaaccactgcactccagcctggatgacggagtaaaaccatgtctctaaataaataaattaaatttgaaaaagaaacagggccaggcatggtggctcacacatataatcccagcactctgggaggccaagatgagagtatcacttgagctcaggagttcaataccagcctaggcaacatagtgagaactcatctctaaaaaatacatatttcttaataaatatatacaataaaatatataccatattttattatacataatatataattgtatgtatttattatcttaataatatgtatatatttattaaatatataaaataaaaaagaaacaattacagacgttggaggactttaaaatatctcagccaggtgcagtggttcaggctggtaatcccagcactttgggagactgaggcaggaggatcacttgagcccaggaggctgaggctacagtgaactatgatcgtgccattgcactgcaacctgggcaacagaacaagaccctatctcaaaaaataaaataaaatgtcttagaagtttagctgtccatcctatgcaactgaatatctgtgtgtaatgtccaccatgtccttctgtttaacctcccccttacttaagccagaaaggcatttgtccccttattagaatatcattggcacatggctgggggtggtggctcatgactgtaataccagcatgttgggaggctggtcaggagtttgagaccagcctggccaacatgatgaaaccttgtctctactaaaattacaaaaattagccgggcgtggtggtgcaggcttgtaagctgagatcacgccactgcactccagcctgggtgacagagcaagactttgtctcaaaaaaaaaaaggggggggggaagaaaagaatatcatgggcacatgtatagaaagtttgttaggctgggcgcagtggttcacacctgaaatcccagcactttgggaggacgaggcagatgaatctcttcagcccagaagttggagttcctggggccaacctgggcaacatatcaagatcctatctctaaaaataaaaaaaaaaagttggatttgatggtgcacacctgtagttccagctcttctggaggatcactagtgccatggttgcaggggcggtgagtttgcagtgacatgagatcatgccactgcactccatcttgggtgatagagtgacacctagtctcaaaacaaaaagtacgggaggggagaaaatttgttgtgtcagcaagtaaatgaagaaagggacattattagagttgagaaataaactggaatgtgatttggtacctctcccgcagaagataagtttgctaaatgtgctgaaattagaagcattgtataaggccctgtgcagtggctcatgcctgtaatcctagcactttgggagacctcggaggtgcccgagcccaggagtttggggaccagcatgggcaacataatgaaaccctttctctacaaaaaatacaaaagttagctaggccttttggatgcgacaactgattgtgccacagagacacaaccctagtggcttaggactctgggaagatataatctccgccgtttatctagtgattgataatgcatgaacgctttaaaagctgaagcaggcagccgggcagggcgcggttgcttacacctgtaatcccagcactttgggaggccaaggcgggtggatcacgaggtcagctgatcgagaccatcctggccaataaggtgaaacctctgtctctactaaaatacaaaacattagccgggcggggtggcgctcgcctgtattctcagctactcgggaggctgaggcaggggaatcgcttgaaccagggaggcggatgttgcagtgagccgagatcgcgccactgcactccagcctggcgacagagcaagactctgtctcagaaaaaaaaaaaaaaaaatctggaggaggcatccctcagtgggctctaaccaccaacctctagattaacagccgaacaagctaaccgattgtgccacagagacaggtattgtaccttcttctgggcactataggaagggtgcactcaccaaacactcccccaaccgtcccaacctcagagcccaccagacagtacaactgtgcaaggctttggaaaactgaagagattagagtggtgaatcgtgttagtctcattggagatccgcaggttgggagattctggaaccaggacgaccttgcccctcgccttcatcaaaagctgccggaaacgccccggccccgacacatacctgaaccgcctgggggcccaagggaaactgaaaggccggtgggctcccgggatggctcttcccgttctttgcgcctccttcacccagtgagggagcctgtgcccactctgcccagtcacttttgaggccgctgaggaacttccgctgccatcttcggatcctgtgtcccgcacgggggctccaccagggcagggatcgtggtgagggtggctcatgggtcccctcgcggggagcagggtctggcactcaccagggcgcacgactaggacttgttgaattaatccatcctcgcctttagcttttaggcctttgaagagccctgaaaatggaaatcatgaaatattttaccatggggaacttttgatttgctttttgttgtttgtttgtttgttttgtttgtttttgagacagggtctcgcttggtcgcccaggctggagtgcagtggtgcaaacacggctcactgcagcctcgacctcccggggccgtcgtcgcctttagcttttagtcccttgaagaaccccaagaatagaaatcatgagatttttccatggggaagttcttttttcaaagcgtctattcacgttgatttctaggcatcccccagggagggcaacgggcagggcctccagtgcaccttctgcgcggtggagccgcgggggctcagttgggcagtagtagggatcgtggggagggagggcaggagcgggggaagagaaaagcaaaagcaaggaaagaagccggggagcggtggaacacacatccggacctcctgaaaggctggtgcagaggcacaggctggatctggaggtgagaattgttttgttgttgttgttgttgttgttgttgttgttgttgttgttgaagcagaatggggaggaactgaggggaaaattcagagacaacatagaagagcttcaaacgcgaggacctataactccccaagaataacatcttccagggacactagacagaaaactaggcatctgggaaccctgaaatccctggaggagtagcatcatcatgaccctctgtgttccttttggcaaaaggacttgcttcccttgtttgtacaattgtttgtgtttgttaaataaataaaacccttttcatatatctttgaaagtatattggctctattattttatgattacaaataatgctgcagtcatcattcttgtacacttctcattggccactggtgtgtttctacagggtagaggcttggagagcagttgctccagcatagtgtttacatattttttatatcattccattttctttccttttttggcttattagctgtaactctttttttcttcttgtccaccgctccccgacttcttttcctgcttttgctttttcagtgatggctttagggttttcagaatacatctttatcagtgccgtctagtgacattctacctccccttctggctgttatgttagtgttgttatgtaatttgattttagacatgttataaaccccagaatccattattatttcttttgtttaattggtcaaattattttaaaagatttaaataataagaacatatatatttaactatgtacataccaattgccactagtctccatttctttttgtagatccagatttctgtatggtatccttatccttaggcctggaggaatccttttgcatttcttgtagtgtgggttgctgaattctttttttttgttttgttttgagatggagtctcaccctgtcacccagattggagtgcaatggtgcaatctcggctcactgcaacctctacctcccgatttcaagtgattctcctgcctcagcctcctgagtagctggaattacagacacaccccaccacacccggccaatttttgtatctctggtagagacggggttgcaccatgttggccaggctgggttggccaggctggtctcgaactgctgacctcatgatccgcctgcctcagcctcccacagtgctgggattacaggcatgagccactgcgcccagctagaattctttcattttttttctatgtatttaaatgtcctcattttagtcacattcttgaaagaattttcattttggcatagaattctaggaaaactttatttctttcaacactttaggatgttgccactttgtttttgcaaaactggcataaagtgggcttcttgtacttgttatataatttttggaatgtgtatttaaattaataacataaaatggggtggactgctgggcgcagtgcatcacgcctgtaatcccagcactttgggaggccaaggtgggtggatcacgaggccaggagattgagaccatcctgctaacacagtgaaacccagtctctactaaaaatacaaaaaacttagccgggcgtggtggctggcgcctatagtcccagctactccggaggctgaggcaggagaatggcgtgaacccgggaggcggagcttgcagtgagtggagattgcaccactgcactccagcctgggcgacagagcaagactctgtctcaaaaaaaaaaaaaaaaaaaaaacggctggaagaggtggtgcacgcctatagtcccagtactttgagagggggaggcaggaggatcgcttgaggctcagagttggagaccagtgtgggcaagatagcaagaccctgttctctgtctcatgtatatatatatatatacacacatatacacatacacacacacacacacacacacatacataaatcgtgaatgtcctagattcatcttaagttccaccaacagtacacttaaagtaaaatgtgcccaacctgagggtcaaacctacctgctgacgtgcagtttgtgtttgtgagacattctcaacagcatttgctttccctagcatagtggttttcatgttttcctcacacctgaatgtcttaagtgcaaaacttgtcagaaataatttcctttgccaaaagattctaaaatactttttttttttgagatcagctcactgcaacttccacttcccacgttcacaggattctcctgcctcagcctcatgagtagctgggactgcaggcctgtgccaacacacccagctaatttttgtatttttagtagagatggaattacatcatgttggccaggctggtctcaaactctgtacctcaagtagtgtgcccacctcagcctcccaaagtgttgggattacaggcgtgagccaccatacctggcctaaaatactcttacttcaagtaaaagtgcattaaaaacaaacttctcatttgcatccctggaatctatagaaagcccggggagacaatcaagtgctacaggatcaagcgctaaacaggggaggacaaagtgtggcttcctcactaggagtcagggcaaagttaactgccttggtttccaatggagaccagaactcggttcccctgtgacgggaggacgcagcccagaggaggccgactttctcttcatggtgccttcagacaggaaatctcctaggatttctttctttccctttgatctactcccaatactccctttctgtttcttcaaggtcttttttggatccctactgcacaggacctaaggggctggtgcccttccctaccctccctgcctgggtgtcttcagcacccaagctcacccagaatgttattgcctgccagagacagtgagaggaccaaggagggcagtgggtgcagtggaaccacagcgtcaccatgtacctgtgcctcgtgggatctgagcaaattgaataaacgccccctgaagcttttctgcaggtcacagggaaggggagggtggctgctgacccagcaagagaagcatcaggaagcatcgggggacctcactgtacccctgtaccttgaagacaggcctggctaggctgattttaatgggtaggccgaaggaaaagtctcaatggcaacccaacccccgaccctgagattacagctttcaaatgtctgattgttttgatgttggtcagtagaatccatcccacctttatcaggagactcctttgccaaaattctgagatctgggattcctgctggttgctgcacagaaagccaatcaccaagatgattattgccaaggaaggcactttaatagggtgctgcagtgggggagatgagaactcaagtctcaaatctatctccctgaccagccaaaaccagaggtttagatggcaggaaagaaatgaacaatgtgtaagaaaacaggaactagggagcagcaaggaagcaatcatgatgaacgaggggtcccagcatctcactgtctggatgaatttcagttctttgatagcttttttgacagtcctgaaggtcatttcctgaggaaggaactcagataaaacaaatattaagtttcaagctttaagaccagaagggtccatttctaggtttatccaaaaaagctacatgtgggactgttgggtggttttcagatcaagaaagaaaaagattgtgcagaccaaagtctgaagttaaccaaagaaaaaacaattttctgaccaataggatgtataggatcagagaatgacaagcctatagaagaactgtttttttgtcctgagcataggggaaggatgaagctgcaccagataaggtggaattaagctgcagatgggcaaaaatctgaattttggttcagagccctggggtcttcctcaaaagtctccttccttgaaagaggaaccctgtcttggtttctgcatctctctgagtccttttggaggttgaggatgctgaggtcttggtgcttggccccctctaaccctgagtacttcccctcctgcagggcaacctggccaagtacccaggccccagctccagcgaccatttccccctactttgctcctagcaaaggctatttctaggtcagtggtgaggcacaggcaggacagggcaactcgttctgacatgttttgccctggaaggccttgagcactgcggtcctgcagaaccactgtctccctcttttggagaaagcagggaggaaatgacctgtgtggagggaatcgagggctgcacctgcatggaggagctgaggcaagcagggcagttccagtctgtaaatgtaaaggacatttgtcatccaagaggttgggctgttattattaattttgaattttgtcaaaacaagcttcagggaaattagtcgtcttacttgtaagaaccttacaagacctcccatcttatattccagggagaattgctgcgtattacatgaacacataggtgagactgctgttctgacctgcaggacttgatgccctggcgcaggggcaccagggtaccggcaaagcctttcccatacaaagagcaaggatgttatgtctacaacccatcggcaccagttccaagtacaatttctgctcgactctatggactgagtacacattccccccagcacagaaatcctacaaactcccatgaatgctatagtgaaaagcaggggctggctaggtgtgatggatcacacctgtaatcctagcagtttctaaacttgagtctaggagttggagaccaacctgggcaacatggcaaaacttcaactcttaaaaaaacaacacaaaaaaacaacaaaacaagcacagaaattagccggctgtggtggcttgtgcctgtgctactccaagggctgaggtgggaggattgcttgagtcaaaatgccaccagatacagtgagaccctgtctcagggaaaaaaacaaacaaacaaacaaaaagaggctgtgtaagaggtcaacagaaaaacactaaggttttcaagtggtgttaaaagccagtgggccttggggaccattgagcaatctacaaagcagggaagcctagatccctgagctccacctgccaagtaccaccacagctaatgtgagagacctcccccacagagactgaaatttgcctcccgaggaaacaagtgactacagacatctgtcccaggataataaaaaagaaaacaaggtctcacaaaaacaaaaacagctgaccacaccatacaatcactgagactgagcctgtgactataggtgaagaaaaaaaggctgtctattattcataccatgaaggaccaggggaaagtgcgaacacagtcccctactactgttgtgggaatcaggagaacagagagaccaatgggtggaacaggaggactttattgagtgtactcaggcccagcatattaaaatccaaaggctgagccctgaacaaagacaaggcttggcttttacacacacttctgaaagggggttggctagtttgaatggcgcagtgggaatttgaaggtgcaaaactcacggtgcaggcaagagggcttacagaagcagaacaaaggcagctaatcaaactgtgaccggtcttgcaatgcaagcatagctggtgaccttgcagctgcactgacaggaaatcaggaacttaaaacttgaataataagaaatggtaaggggaaaagagaaggtagtaaagggatttgttgttttttcctcttatccttgctaggggcagactgtgttgagagagtctctggaactaattcctcagggctctggcttttcagacagtgttatcaaggatctgctagggctctatctattgctggccttggagtcagtcaagtactgtgaagctcagttatgcagctgagcttcacacattaggggagataacagagaacagcacatctggagtgcaatggatgagcctcaaccttaggatgaaccactattggtgaccataggatttcccctaccaggtaagtggcagtccacatacctctgccccaccacagctccatatgcctcacctttacacgcatggtcacttgctctgagaaccacccccaccaatctccaaccaccctgagccctcctagccctaacacacagctgggactctcacgtccacccagcagtcctggacttgctcctacagcacgggaaatcctccatggtgaagaagcagccctgtgctacctcatctacatagaaatgccctatcgatgatgtcaccgacaatacctttcttaatgttctgaagattattaaattagatttgtatagttgtgaaaagtgctcatattgctgattccattgcttacatatgatcatataagtcttttctctcctttctgtagtgtggtttaaacttaatccttaaaggacatgtatttgaatttttcagctggttagaaacctgaatataccaatcaaagaaaactgctccttacatgctacagatttggttttcttcctgtactaagatgtcttttagatatagtaaatttgttaaagccaagacttcctatggaacgaagtttgatgggaggggggacattgagtagtaagatcactcttgtaacagggatgccactcttgcagatattgacaactattgggcccataaaatttttaccaaacattggaaagacaagatatgaacaacttatcattgctgcagtctcaaatatcaggaaataccattattctcaggacaataaatagacaataaaaaaagtctcacagagcagattagctgtcatgtattaccaaacagggattggatccttgtcaacaccacccaacagaaattgtccatacaaattcacttcataacatcaaaaccaaaagcccacactgatggcaaaaaataatgacgcaataatgagagagagagagagagagagacctgtcctatagccatacttagtgtgtaaaagccaaagagctcaatttctgctcatgatacttaataaaacagacggaacatgagccaataattcagtgggttcagatctgcaccaagtgcctgttggatgcaggattctactgtctccaataatatgtctcagatggactagtttttttttgttgttttgttttgttttgttttgagacagagtctcgctctgtcgctcaggctgaggtgcaatggcatgatctcagctcactgcaacctctgcctcctgggttcaagcgattctcctgcctcagcctccccagtagttaggattacagacacaccaccacatccagctttttttgctttttttgctttttttttttttttttttttttgtatttttagtagagacggagtttcgtcatgttggtcaggctggtctcgaactcctgacctcagttgatcagaagtaggtgaggtcagaaaacataccctgggaaatgctggcacaatgcccagaaccgccatctctaggcctggggttttcttttgtagtggaatactagtattcatgcaatgcagggacaagaccaattagatacttctgggagttaaaaagagatgaatttacagtgccatttgagaaggggtattaaggaatttgccagggtactgacgcgtgtcaggtgcaaactgcaggttgaaagagagctaagtattttctgtccatgaaggtgataagggagggcctgaagaaagacggaccgggaaggacactggcgccagaagtaggaaagggctgcttgggggtgggaaggatgggtcggggtgctatctaaaaagttgcctggcaatggatgtaggatatggaagcgagacatcaaacaagaagttgtcatttaaataaagtctgaagaaagactagatatgtaaacagcaggagataatagggaaactggaccccgctgctcataaaacttcctgccttatatttcagggaggatcgcagcgcatttcagccaagacaagtaagactgcggttctgacctgcgggcctccacgaattgcattagggcacctgggctccgggaaagccattcccctacacaaagtaagcgtgttatgtctgcaaatgaacggggacactaagagccccaaaggccctgctttcatcccaaagaacagcgcctgtctgcgtagtttgtacctggctctatgaggtgagaacacattccccgctagcacagaaatcctacaaactcctgagggggctgcggttagaagcaggggctgtgtaaaaggtgactctgggggctagagaaaaccacgaagattttcacagagcgtgagaacccaagacactggagaccatggaccaatctctgcaaaaagcagccctgcgtagaaagggaagagctgtacggccttcgcgctagtttgtttgtgttaaggctgacgctccctatttctcctcagtgggagaagcgacatcttaattcctatttcccagccttccactgtaagaataacacgtccaagacacaaatcaatgaaagaaaaaagtagcccttagagtacagcgtattcttgaaactacaaaaaatcaggggaaagcgcgaacgcagtaccactaccacaaattatgcaatcgagtttcccacatttggggaaatcgcaggggtcaacacatctggagtgcaatggataagcctcgccctgggaaaaccaccttcgtgatcatgttatctcccctgccaagtaaatatgagctcctgcacctccgccccgtacgcctcaccctttacacgcacggtcgcttgccccgcgcaccccccagccctcctagccctgacacacagctgggactctccggccggaccagcggtcctgagcccgctcccaaggctcgggaactccttcgaggcgaagcagcaggtggggaagcagcagctcctgcgctgcctcatctacatagaagtcgccctatccgtgatgtcaccgacagtgcctttcccaggccccatctgcctttctgccagtcagccgaccaacccgctgcctgaaccagcaagaggaagtgacgtctgcctctccctttttccctcccgccccggcatctgttttcgcccaaagaagctggtccttagcctatcttgtgaagcaaactttcggtggccagatggagcctgggtactcttcttcacataatgacttttatttcgcagactagaacgtttaggactacaaaagaaaccggttttcttcacatacttatccttgtaatgtagcattccgcttgaaattggaagccgttcaatgtcacagagaaaccatatttatgaaagtaaagaggcttctcagatgactgcaaaccagccttccttactgattttatcactggtaatgttataaaaacagttgtcaagtttaatgaatcttgtagttttttttatttttatttttatttttttccaaattcagtattgtggaaaaatatgctgccacagaagaaatgattggacactctcaaatgtggtgttgcactttgtcatcttttgcacagccatctccagaccttattgcttacctcgtgttagttttttatattctgcaaagacaaaaccaaaataatccaaatttgacaaaaatacctgggatacatcttatttgtgatgcttaacaaatgtctggatcatcttttcttatatgggattataatgcaggaaacactgtgaagtaagcaaagttggaattcccaagtcaaagaccatttgaatatttacaagtagatttgagacaggaataatacagggtggtcacaggataacaaattctaggcagcagatttacatgacttgaggctatgggctgataagatgctgaaaaaccagggtgtggaccaagctggctaagactgactggacccaatgtggtgctggatttgacgtaggttttacctaggccctcattatacgcttattaacatactaaatcacacacccaccagtgccatgacagttctgagaccaatatttgatgtaaaaatggatggcaccacagttctgagaaatctccacctttacccaggaattttcatcaatattccactccttggttaaagaaacccattgagatgaaaccccagaacccattgttctctctcaggtatgcccaaactcccctttcttgagtgtgtactttctgctttgcaataaatctcttctttcactatttgctaactcatccttgacctcattcttgagatggtgtcaagagcctggacaccacagctggggtcgagatcctaccagtgtccggggacctcccccagcccaccagtatcagattctattccattgctcaaatcacaaaacatcaaatggagaattcttctttggagaccacaaagtaaagattctgtggcatggtggccagttaggccactggaagacatggcaaaatattgaaaatgagggattaggtgacagcgtagtaactgctgaatgtgaaatacttgatccagaccccattccctgtagactgactgggagacacattgtccaggtagtagtggagaaatactttctgggtatctgaccagcctttgtggaaagaactggcaccatcctgcagatgtaaccacctgatgggttcttcctgcccactgtacacacaaaatcaattcacggagaccatggcattgcagtaaagagtttaactgacacaggctagccatgacatgtaggggacagagttattactcaaatcaatctcactgaaggcttggaggtaagggttttttcaaagacagtttggtggggagggggctagggcttgggcggtgctgattgttggggatgaaatcacaggggtgtggaaaatggccctcctgcattgagtcagcttctgggtgggagctaagggactgattgattttcgggccaaatggtgccatccagtagtcagaaatgcaaaagcctgaaaagacatctcaagaggccaatcttaggttctacaatagtgatgttcttcacagcagtaactggggaagctgcaaatcttgtgacctctggaataatggctggtgattatttaatgaggcatacatcttagtagaattcaggtccctttcatcctcctaacttggtggcctttcattagttttacaggggtaatttagctttggggaaggttatcattttaaccaaactttttggctgtccccagtgtttttggcaccagggactggcttcatggaagacagtttttccatggaagggggtggtggatagtttccggatgaaaccgttccacttcaggtcatcaggcattagttagagtctcataaggagtgcacaatctggatccctcacacgcatagttcccaatagggttcaagctaatatgagcatctaatgctgatgctgatctgacaagaggcagagctcaggtggtaatgctcgaaagcctgcagctcacctcctgccgtttggctgggttcctaacaggccatggaccaatacctgtcttgtggccctgggggtttgggacccctgatttgaactataaactcaatttttcccaaaaatagcttgggagaaattgtgcaggaatgagcaaagacagctagcctgtgaggctagaaccaaaatggagtcagccatgtcagatttctctgattgtcataattttgcaaaagtagtttcagagggactaccctgacacttgttaaaagcatgaggcggattttattgtatgtactacagtaggcaagagagaccagcagagaaccgagctcaactccaaatacagcaagaagggttgaagatttatagccaatcggcaaggtaagaaagtcagtggatggaaaattactaagaggaacttgattaactatcaaaggtggttgggaggactcttgctaaactaggctcaacagtattcttttctaaaactggacttggcaggccaagaactaatagagaaaagggctcagaggaaactgactaaggtttggtcaaagatggagtccttgtcaactctacattgaagtttctgcaaataaacgaagaccaaccaaatgaaaaaaagtaaaggctatttattctgagcttgctatagcagggagtcagccactgttacttgtgttttggcagagacttgaaggcagtcagagaagtgggaaagctttttacaaagaaaggcttcaggtatgcttcaactggaggctgtcagcatgatgaagctagatagatgaaaaaatcaaaatattttaccccagaatatatttctttggcatattttaagatggccgtcagagagccagcaacagaagtaactctgcaaaactgtcttttataggggaaatttacacctacagagaatctgcattaatctagccttcccttgtcaggattgagaaataaaaataagccctaggccctacagccaactgaacagactccctcttggctgacaggaccgcagagaaaccttgaaagctgtttctggctgtggcaggatagaaggctggacatgcccccttaaaacccctccctcactaaccgcggttatgaggcaggagaacagcagagggagttggaagttggataaaaggcagaatgagtaaaagcagaaacagaagtaaggtgatggggtgggagagcaagaagcaagataaaaggcataaactaagcaaccaaaacaaaaagtaagattaaaaaaagcaagcaaggccaggtgcagctgctcacatctgtaatgccagcagtttgggaggccaaggcaggtggatcgcctgaggtcaggagttcgagaccagcctgaccaacatagtgaaaccccttctctactaaaaatacaaaaagaaaaaaatagctgggcatggtggtgcactcctgtgctcccagctactcaggaggctgagacaggagaattgcttgaacccaggaggcagaggttgcagtgagccaagatcatgccactgcactcaagactgggcaacagagcaagaccctgtcttaaaaaaaaaaaataaaacaagcaagcaaggaccccatggccagcaagatccaaaccaataaaggggcagctcttcagagataggcatgtgcattagagagaaaaagtatccttaacatgacttcatatgataatcagctcattaaagctcatgcatatggactgcatatcatgcatgtacttaaaattatgggatagaggcaacattcaagcacacaagggccaaagtaactaagcaacccacctatcaatcaaatggcaaaccctggctaaagattaggcattcttggcctggcacggtggctcaggcctgtaatcccagcactttgcaaggctgaggtgggcagatcatgaggtcaggagatcgagaccaccctggctaacacggtgaaaccccgtctctactaaaaatacaaaaaaattagccgggcgtggtggcgggcgcctgtagtcccagctgctggggaggctgacgcaggagaatggtttgaacccggtaggcagagcttgcggtgagccaggattgtgccactgcactccagcctgggtgacagagcaagactctgtctcaaaaaaaaaaaaaaaagattaggcatccttgtgaagaaaaaaaaaccacacatcaaaagacccaatgtacaccaaactaatactgatctcatctcccagaggtcagcccactctccccactccgagagtgttactgtgcttaataaacttttgctttgctttgctgctttgtgtgtgtcatgtacacttctttgggacaccaacagtctggaactgcacggtaccatctggtaagaattaggcttttttggccgggtgcggtggctcacgcctgtaatcccagcactttgcgaggccgaggcgggcggatcacgagatcaggaaatcgagaccatcctggctaacacggtaaaaccccatctctactaaaaatacaaaaaattagcccgacgtggtggcgggtgcctgtagtcccagctacccaggaggctgaggtgggaggattacttgagcctgggaggtgaaggttgcagtgacccaagcttgcaacactgcacttcagcctgggtgacagaggaatgggccttcactagacactgaacctgctggcaacttgatcttagactgaccatcctccataactgtgagcaataaatttttgttgtttataagttactcactctgtggtattttgttatagcagcacaactggattaagacattaacctgaccttaagaaatcatctcaaatcagtcttggctttgatgagaaacaaagggcacactcgaatgtgtgatttaaagagagttttttttttttttgagatggagtctcgctctgtcccccaggctggagtgcagtggcatgatctcggctcactgcaagctccgactcctgggttcacgccattctcctgcctcagcctccggagtagctgggactacaggcgcccgccaccacacctggctaattttttgtatttttagtagagacggggtttcactgtgttggccaggatggtctcgatctcttgacctcatgatctgcctgcctcggcctcccaaagtgctgggattgcaggcatgcgccactgcacccggcctacagagagttttatgaagagaatatttataaatatatggacaggatcaaaataacgcaagaaaggactgagaggcactcagaatctggaatcatcagagaagttgtattgcctctaggactgaattgttgtataagtctgttcaggttgccataacaaaataccatataccaagtggcctaaactatagaaatgtgtttctcacacttctagaagttgggaagtccaagataaaggtgctagcaaagcggatttctttctaagatctcttcctacagcctgtaagtggctgtagtttcactgtgtgcccatgtgaccatttctttgtgcaccatggggaaggcggatgagcaagctttctagtgtctcttcttataatggcattaatctcagcataaggaccccactctcataacctcttttaaacctgattacctctcagaggccccagctgcataaaccatcacactgggggttagggcttcaacatttaagtgtgggagttggtgttcacaattcagtcaattggagtggaaattgaaatgggaaaggaaaactatagttactagagagagctattgtcttggagaggatcactggacaggactatagtctttggagaaataagtgagtgacaactgacaaagattctttctgtgaaaataagtaatttaaaatgtaagttgttggaattccaaattactttgagcctttaaaaaatctgagtatgggccaggcaccatggctcacacctgtaatcccagtactttgggaggcccaaggcaggcagatcacgtgagatcaggagtttgagaccagcctgactaacatggagaaagcccatccctactaaaaatacaaaattaaccgggtgtggtggcgcatgcctgtaatcccagctactcgggaggctgaggcaggagaatcacttgaacctgggaggcagaagttgcagtgagctgagatcgcaccattgcactccagcctgggcaacaagagtaaaactctgtctcaaaaaaaaaaaaaaaaagaaaaaagaaaatgtgggtatggagcctaagtcacatgagaggcacctgtaaactaggcagttttaacctttgtttctctgattatagattggccttcttccttacatacattttttttttttttttttgagatggagtcttgctctgtgggccaggctggagtgcagtggcatgatctcggctcactgcaaccttagcctcctgggttcatgccattctcttgcctcagcctcccgagtagctgggactataggcgcacaccaccatgcccaggtaattttttgtattttagtagagacggggtttcaccatgttagccaggatggtctccatctcctgacctcatgatccacctgcctcagcctcccaaagtgctgggattacaggcatgagccactgcacccagccacacgcattgttttctaacatgtcatataaattattgaagggtgccagggaagattgcttccctcttcactgctgactttcattatagattaacttccttcttaccttgctctcataaagacttcatggctattgcattgtcttaagatgcaatgttaaatacactcctttaaattggaaaggaaatgtgagccagctataaagaaagaaaacaagtagtatggaaagagaaaaaggttgggcacagtggggctcatgcctgtaatcccagcactttgggaggctgaggtgggtggatcacttgaggtcaggagtttgagaccagcctggttcacatggtaaaatcccatctctagtaaaaatacaaaaaattacctgggcatggtggtgggcacctgtaatcccagatattcaggaggctgagacaggagaatcacttgaaaccaagaggcagaggttgcagtgagccaagatcatgccattgcactccagccttagcaacagagtgagactccatctcagaacaacaacaacaacaaaaaaaaaaaacacaaaaaaacaaaaaattctgcaactaattaatttgttgtaactcttaaagcagccttatatagaaaatgttgtgatcctattaatttttttttctttctatgtaagcaagaacttcacttttgactttgcagcactgaccccatttctctggagtctgtgtgccctgattggctattcccagatttttgtttgaataaactcttttttaatttttaccattagttcccacaagcagaatgaataaacattttaacactgaattctgaacctttcatttatttcaggttgacatctccttggccaaactctaatcaggctcttctgagtcctcttctcactaggcctcaactattgagcttctgtgttcctctctgcattgttcaatctcagcaagaatccttctcagtcaatttagccagaattccccatcttcaatagctgatcactcataatatctaatagggctcctcatccttcaccatctgctaggtgatgtctgatcaccctgcgttcagcaagaatgctatatgttggcttagccatgtgggaagcccaaaatatgccaccccaaaatacactcctttggtataatttgagatggctatttagaggggctgcagatgttactgaggggtctcagcccaaaaagggactctttcctgtttattattgcaaagccaatgtatgaaaccaagagtgagtgtcaagcagtgcaggctctattcaatggcattggagaagtaggagcatagcatggaattggagaagtagtatagcttgcaaatcaccttctcggctactgagaaccaggaagttacaaatatagaggatctttaatgaagggaatgagcaaggtgaggaatattcatgcttttcttaggaagggatggagattttcctagaatcaaggagtcacctcatttctgtcctttcttggtctctttcgttcattgtcacagtgattgtcaactgtcatgcactgatgggagtgctatttagcatggaaattggattataataaagctagatgtttttcagaggttgcataagctgccatcatggatttcaccagcttcagctggtttagtcccaagaagaaacttctgaccacagacatcctgtttcttaaaaataagcagagttaaaggtgagtaagaattcagccatgacacatatgcactgcaatggccaacaacatctgggtaggggtccaggtaagtcatgtaggcagtgcaataggtaacacagtcacagaaatacctatgaaaagctgtccttttgtcagggagattagcatgtgtagaggaagtaaacatcaactgcaaatggctttctctgagaccttcttatctgctttatccggatccaggtaagattaactcacaggaaaaggaaacaaaagatctcatgcttttaaacgtctgacagagaaactttttttttttgaaacggggtcttactctgacacccaggctggagtgtgcagtggtgcaatcttggctcactgcaacctctgcctcccaggttcaagccattctcatgcctcagcctcccgagcagctgggattacaggtgcccaccaccacaccaggttaattaattaatttattatttatatatttatttatttatttatttatttatttatttatttattttagacagagtcttgttctttcacccaggctggagtgcagtggtgccatctcagctcactgcaagctctgcctcccaggttcatgccattctcctgcctcagcctccctagtagctgggactacaggtgcccgccaccacgcctggctaatttttttgtatttttagtagagacggggtttcactgtgttagccaggatggtctcgatctcttgacctcatgatccacctgcctttgcctcccaaagtgctgggattataggcatgagccaccgagcccggcctgtatttttagtagagatggggtttgccatgttggccaggctggtcttgaactcctgacctcaaataatctgcccacctcagcctcccaaagtgctgggattacaggcatgagccaccacatctggtggagggctacttcttgagagacttcatctgcatcacatctgcatcacaacacagcctttgctcaccatgtctttcctcccctcaacctcccataacctgtggccaccaccccctaagaactccaagcctagttagtcctttttgtgctgcacataaacttcaaccatacggccttctttgaggcttttttttttttttttgagacaaagttttgcttttgttgcccaggctggagtgcaatggcgtgatctcagctcaccgcaacctctgcctcccaggttcaagtgattctcctgcctcagccttccgagtagctgggattacaggcatgtgccaccacaactggttaattgtgtatttttagtagagatggggtttctccatgttggtcaggctggtctcgaactcctaacctcaggtgatcaggatccacccgctttggcctcccgaagtgctgggattacaggtgtgacccactgtgcccggcctgaggctcatatttttatgtgactctgtattagtcagggttctctagacagacagaattaataggatagatatacaaagtagtttattaagtattacacttactttttttgtctttttttttcttactttttgtggaaaacagggtcttgttatattgcccaggcaggtctccaactcctgggctcaagctatcctcccgcctctgcgtctctgagagctgggattacaggtgtgaaccaccacacctggccaggagtttattaagtattaacttacacaatcacaatgtcctgcaataggctgtctgcaagcttaaggagcaggaaagtcagttcaagtctcaaaactgaagaacttggagtctgatgttccagggcaggaagcatccagcacaggagaaagacgtaggctggcaggataggccagtctggccttttcatgattttctgcctgctttatattcatgggcagtggattatattgtgcccaccagatttagggtgggtctgctttccccagcccattgactcaaatgttaatctcctttggcaacaccctcacagatacgcccaggatcaatactttcatccttcaatccaatcaaatttgtgagaaacaaattcacctgtctaaacccaaacaatgaactcagagacccagagaacagcgaaagtgagacttttaatgacggtcttgcaagatcgggtgtctggcatgcaggcacacccagcacagtttcaacaagcaatttacgccctagtgcacaggtccctccctcagttcctcataggctgagtactagccttccacaatcttcctagacatcacctattgattgttcttcaagtacattctttagggtctttctgctgcattttattgcagcacacgatgcattatgactctcaggatttttcaaacatttgacttacggctctagtggctgcacttagctgataagaaagggtacaattatctatgttgcaagctagcttaaactaaatttctttgtggagcggggaaggggtagatgagggggcccccaccgatagatgcctggccactgggtgaaagggaaagaaggaaggtggagggggtggctcagtacattctgcttctttatttctttctttccaggtagcctgcctaaacctataccaagccacttagaattgaaaatagataatcacatataggttatttcctactattccctcctttttctttttaccctttttggtgtcattttcacttaaattgctttttcaaactgttccagaattgtttacttttttttttcagatggagttttgctctgttgcccaggctgcagtgcagtggggtgatctcggctcactgcaacctctgccccccaggttcaagcgattctcctgcctcagcctcccgagtagctgagattataggcgcgctgtaatttttgtatttttaatagagacagggtttcaccatgttggccaggctggtcttgaactcctaaactcaggtgatcatgagcacctgcttcagcctcccaaagtgctgggattacaggcgtgagccaccgcgccaagccagaagttgtttactttctttctcataggaggaggagtttatttggtttctaataatagtaggttattttgttggaacatcaggggcatctgtttactgagagttgttttaataaaccttagtgttatatatatatatatacatatatatataaaatatattacatctattatatatagtagtagtgttaaaccccttacacaagtattgatgcaacatcgtatgtcaatgacagaatctgttaagttggaagagtatactgtagaaggtacatacttcactttttttttttttttttttttgagatggagtcttgctctgttgcccagtctggagtgcagtggcgcaatctcagctcactgcaaccaccgcctcctgtgttcaagcaattctgctgcctcagcctcccaaatagctgggattacaggtgcccaccaccacatctggctaatttttgtatttttagtagagacagggtttcactatgttggccagactgatcttgaactcctaacctcaggtgatctgcccgccttggcctcccaaagtgctgggattataggcataagccaccaccctggctcatagttcactattgaaacaaacttttttttgtgtacagaagaaaaaaaatcgtacagttaacagtgtcagagatagtgaaaatatgaaacaagaactgcttacaagaaaggagcactcaggggaccaaacctctgccagagccagcggggaagtgacttatgcctctctcttctttccctcctgtccccgcccctcgtctcccgcaatgaagcgggtacttaatctgtgtcctgtggaggtcccctttggcagccagctggaagcccgtgcacccttcttcaaataatggctttcaatgagcagactaggacgtttaggattgcaaaggaaaccgattcctttcaaacctgattatctttgtgatgtggcactgtttgcatatcttccttaaaatgcattaaaggccactgcactccaccctgggtgacaagaggtgactgtgtctcaaaaaaaccaaaaacactcccccctcaccccaaagcattagacgtcaaggctggcagggatgtctgttctcttgaaagttcaatatcaattcaatactttaaattcactgtagtttcaatccattggtatggaaagtgttttgaattattgtactgatttttttctatcctctttctgatacgcatgctaatcgtatggaccttggacatctaccttcctgaacttttctctcctgtttttacattattattttggtttgtgggaaatattcttgacattatcttcaacttaatttttgttcttgcttctactattttagtttaatttccaagtattttgatattgaactttcaagagaacagacatccctgccagccttgacgtctaatgctttggggtgaggggggagtgtttttggtttttttgagacacagtcacctcttgtcgcccagggtggagtgcagtggccttcaatgcgttttaacgaagatatgcacacagtgccacatcataaagataaccaggtttgaaaggaatcggtttcctttgtaatcctaaacgtcctagtctgctcattgaaagccattatttgaagaagggtgcacgggcttccagctggctgccaagtgggacctccacaggacacagattaagtacccgcttcattgcggcagacgaggggcggggacaggagggaaagaagggacaggcataagtcacttcccccgccggctccgacagcgggtaggtccgctgaggggcgttgggtgaggcggaagagcagacggggatccggaaggcgttgtcggtgacatcacggagagggcgatttctatgtagatgaggcagcgcaggggctgctgctttgccacgaaagagttcccgtgccgtgggagcaagtctgggaccgctggtcggaccggagagtcgcagctgtgtgttagggctaggatggctccgggatgcgcgtgacgcaagtgaccttgcgtgtaaagggtgaggaatatgaggctgcggcggggcggaggggtgtgagcttatacttatatttatctggcagaagaaatgttatgatcacgaaggtggtttttccagggcaaggcttagcaattttactctggatgtgctgacccctgtgatttccccaaatgagggaatctcgactacataatttgtggcagtggggaactgtttgtgctttcccctggattgctgtcgttttaaaagtggattttgtttgctgtggaagcatatacaacgcgttagtataaactaataaacaggtctttgttcccatctgtcacttactttcaaagtaaagattttgtcaggtagtggttggttctcacgcttgtaatctcagtagtctgtgagatgcattgataactttatgttaataccgctcgagctctggagtttgatgtcagtgtggtcaaatatggtggacccgtctctactaatctcttaacttttttttttgttctatagaaataaaactaagcttttcttttccctatgggagcccactgtaaacatttattaacagcaaacagttcactggagtgcatggcttactgcaacctctgcctcctgccttcaagctattctcctgcctcagccagagaatactcgatctcctaggtaactgagattacaagcgcaggccactaaaaaattaggcccggctaattttttgaatttttggtagagacagggttttaccatgttggccaggctggtcttaaactcctgacctcaagttatccgcccgcctcggccacccaaaatgttgggattacaggcctgagccaccgcgcctggcctgtttacagactttacagacagattttgtttacaagctttacacgcacggttcagttgcagttagtgtatattatgctgggcccaagacaagtgtcttttttttttttcccagtgtggcccaaggaagccaaaatttagacaaccctgctctagagggtttgattcatgtttccactgggttatgcttattgcctgtaattccatttgatattttccaaatttgattttttaaaaagcgttttcctgaagcaccctaaagctttcctaataatatgggaacttaaaccagattggatgtgacaaaaccctgctggaatcctgcaacttctaaccttaatgttagatcaagaagcaaaacacccaccagtccaagggtcagggaagatgaagatcatgcctgagctgtaacaacgcccttcccagtatacaaaagcgtgtaacagccactcgaattctatcttccaagtgtctcctgttgcccaggctaacctagagctatctaaagatggcaaatctgggaaatgtgcattcagcttggcaaaactgatacattacaaatccaccacagtccacttcttctcaaagtggcatcaatgtgcaccttcctcctcctccttttttcttcctcttcctcatcctcttctttctcttcttcctcctttttcctccttgtaaagccatacttaaggttcagataaagacaataggaaaatcatactttttctcattcagtgaaaatatgccaaccctttccccaacaggataaagtcttttatttgtctttgaatgatgttcactccttttttagctagatcacattccatatttgctatcctgtaacctaaatattgagatttctaaaagttaattattaatgaatatgatagcgaggatgatggaagacgagaattctcaagaaaagtattggttaacatataaccaaatgtattcatctcaaaataatgaagaaatactcctaactattacaagtcctcatttctgcaactgtcactggccctagctggtatttgtaactatctttacatcttgctctcacagccatttcctttgggcctgggccggtggacgtgagcgtgggaaagaccagaacccgcggtgccccccaccgcactatcctcgggtctccagaggtgggatccactgggcaggggcctttgctggattctaaaccggctctggggatacaagaacagctgcctttgagaaacagttcaggtctctatattccagacttcttagtaggactaaacccttaattttcacccgggaattcatggttctcctaaaaccctgcggtggaatgccttccttcaccgagcatttattgggcacctactaggtgctagggtggctctgggcgaagggctgcagcctgtgcaaactccaggtccctttcctgtggatcccacctctgaggacccgagggggacgcagtgaggacaccacgggttctggtccttcccacgcgcgcgtctgctggcccaggcctggcagaaatgactgtgagtgcaaggtgtgagcggggctaagaatgggaaagagagtgactttcgcctgagaagctgcagttgtcgcctgtagaggggccggcgacttttgagacggtgaagagcaggcggaggaagcagtgaagagcagacggtgaggagcaggtggacctttggccgttggagtcccccagctgactctgccagagtagaacgtccaaagtgcccaaagactcgactcttggcttcattgtctcccgtattatgggtttctggagtgcgcgggattggacaggcatcaaatacatgagattatctgcagccagaggttaaaaagccatttctggtatcagcaaatgagtttaagacacaagccattggagtctctgtggcgcaatcggttagcgcgtttgactgttaactgaaaggttggtggtgcaagcccatccagggatggcaccttttgcttaggcaagattcacactttctgtttaaagactttaatcctgggaatcctccggacctctattagctttgaatcagatgccaaaatatgctgcgtgaaggctcaagttccatggaagttcctaaaaacaggaatatttcagcaaaagtaatttttcaatagagcctgagcctggggcttcagagcttacaccagagccactgcacctatttcatcacctcctgaagctgggtttttacaattgcacattcctggaaatccaaaactcccaataattgaaaacaagaaaaccccagtcttcacttgtggtgaagcctcaatttctgggttgaaatcttggttcattcatgacgtgacttttaaaaccttactggattttctgtacctcaatttcttcgtctataaaaaagagcagccaggcgcggtggctcacgcctgtaatcccagcactttgagaggcccaggcaggtggatcacctgaggtcaggagttcgagaccagcctggccagggtggtgaaactccgtctttaataaaaatataaaaattagtcaggcatggtggcgggcgcctgtactcccagctacttgggaagctgaggctggcaggcacctgtaatcccagctactcgggaagctgaggcaggagaatcacttgaacccgggaggcagaggttgcagtgagccgagatcatgccattgcactccagcctgggcaaaagagcgagactccttctcaaaaaataaaaataaataaaaaagaaaaaagaaagaaagaaatttttcctggcacatttctatatgttccattctggatgacttgctcttcaggcttatctcacagctgttatcataatatctctctttactgcaccatcttgggatttccatgacctctctcttgttagatcccctgcttcatggatctcaagggggtgcattcctcactcacttcttccttttgatgatgcatatccttcaagacctcctataaagtggttaccttagaaataaactttttgagacactgcatgtctgaaaatgtcttttatacccataaagttaattgatattttactagatagagatacaaaaagataggtggaaataatttctctctgagatttttgaaggcactgctttttttttttttgtgacagtctcgcctcgctctgtcacccaggctggagtgtggtggtgggatcttggctcactgcaatctccacctcccaggttcaagcgattctcctgcctcagcctccccagtagctgggactacaggtgcctgccaccatgcccggctaatttttttatttttagtagagatggggtttcaccatgttggccaagctggttttgagagcgaccactcctcatattgtcttacacttaatttcttgtttgctgaaaaagtggaggttgaaagaatgggcagaagtgaaaatcacgctcagacaactgggtgccacatttcaggcctggttgttaaaattcaactgctgacctcaccaattgtgctgtctgtaaattccagacattgtataaaaaagcattatgaaattcccttttctgtcctgtttcattctgattaccagtacatgcagcccccagtcacgtacccctcgcttgctcagttgatcatgaccccccccccatgcagcccctttagagttgtgggcccttaaaagggacaagaattacttgtttggggagctcggtttctaggatgtgagtctaccgatgctcccagctgaaaaaagctcttaccttccacaatccggtgtctgagggattttgtctatgactcctgctacagtttcaaactcctgacctcaagtgatccgcctcccttggctttgcaaagtgctgggattacaggcctgagccacaacaagagctcccggcccttgttgtttactgctttccatagtcatttctgagaaagagaaaggtaagccttttctgctctgagctagagctggtctgacaaacacctaggccatggtgttgtatggttaaaactaaaaatttcacaacaccaatatcagacaaagttaccccctcactaaactgaaagaaatactatttcacaatcatatttgagcataaaaagaacactgttcaaaccataatatgatcaaacatcccagctactaatagtgacggttaattattttattttttatttttttgtgatggagtcttgctctgtcaccaggctggagtgcagtggcacaatctcagctcactgcaacctctgcctcctgggttcaagtgattctcctgcctcaaccttccgagtagctgagactacaggcacctgccaccacacccagctaatttttgtacttttagtagagactgggtttcaccatattggccaggctggtctggaactcctgaccttgtgatccgcccccgccccgctcagcttcccaaagtgttgggattataggcatgagccactgcaccaggccatttttttttttttttttttttgagacagtctctgttgcccaggctggagtgcagggccgtcatctcagctcactgcaacctccacctcctgcgttcaagtgattctcctccctcagcctctcaagtagctgggattacaggcatgcccaaccatgcttggctaacttttgtgttgactgttgattctttaccaattatgtgtttagtcttgcaaccatttctctcactttctagataaaaatatcgagattcccaaaggaagaattgtcccacaatttccccatagtgtttgctgtctcctctgttgcaatgagccaatatactcaggtttgactataggtttgttcctgatggttacacactggagcacatcagcaccatagagaagatggatgccgttctgattctttgttatttgccttaaacttttctcccatctcccctcccaaaagcctatagaatcttctacctcttcctattagtttgaaacttcatgatctatttccatccaccatgctgggtactcagtgtgctctttcaatatgggaatttgtattttggaggtatcattccaaagatgtttatgcatatacaattaaaggtatatatttatttcctgcaactaccatcacccttttgatacacttctgctgtataataaaccatcccaagcttattgacttagaatagcaataattggctgggcgcggtggctcacacctgtaatcccagcactttgggaggccaaggcgggcaggtcatgaggtcaggagatcgagacgatcctggctaacacggtgaaaccccgtctctactaaaaatacaaaaattagccaggcgtggtgccgggcgcctgtagtcccagctactagggaggctgaggcaggagaatggcatgaacccgggaggctgaggttgcagtgagccgagatcatgccactgcactccagcctgggctacagactgagatctcgtctcttaaaaaataaaaaaagaataacaataatttattatttttagtgattctgtgagttggcttggaaattcttctagtccaagctgattcatttggggctggatggtctaggatggcctcacacatctggggtataggtggattggttggaaaaagtgggatgcatggatctttttcttcatgtgatctctctagcaggctagctttgggggatcttcagatcatggcctcaggatttcaagtgaagaaaaaagcaggtaatcctcccatgtgcaagcctctcttctgccaggtttgcgaaggcaccaacatttgcccaaagcaagtcatatggccaattcaagattcaaagagaggagaaatagactctcttgatgagagaagctgcaaaatataaccactttttttttcaatctatcacagtataccatactggactatcagtagcttcctcatttttctttctttctttctttctttttttctttctgagatggagtctcgctctgtcgcccaggctggagtgcaatggcgacatctcggctcactgcaagctctgcctcccgggtttagccattgtcctgcctcagcctccctagtagctgggactacaggcacccgccaccacagccggctaattttttgtatttttagtagagacggggtttcaccatgttagccaggatggtctccatctcctgacctcatgatttgcctgcctcggcctcccaaagtgctgggattacaggcgtgagccaccgtgcccaatgaaaacctttattttcgtgatggctgcttatttatttatttatttatttatttatttatttatttatttttctttccctgctctccctctttttaaatttttattatttatttatttattttttctgcagagatttatccaattcagaggtcttgtccccataatttggaactttcctttggatttgatcaagtcagatagaactggtcaaacccaatggggaaaagaaggaaacaacaataaaaacacaaacagaaaacaaaaaacagttcagaaaattagtgatcgcacaatttatatgattgcctagcactctaacggtaagaagaaattataatcagttggttgttaatcttttttatttttttattttttatttttttttgagacagagtctcgctctgttgcccaggctggagtgcagtggcgcgatctcggctcacagcaaactccacctcccgggttcacgccattctcttgcctcagcctggttgttaatcataactttaatcatttaggagaatttccaagacaaaacacaggttcagttacttacctaggaatggggcccaggctgaagactgctctgtaccatcttagaagcaggaaaaaactcaaactctccttccctccttccctgttagaagtgaactgaaaccccagaaaggaattgcctgctctccatcatcatggaagcaggaaaagttgccttcattgttggaagcaagtaaaactccagaaaatgagttgtacagcaaaataaagcttagatctcaatcaaattttgggaaatcagggattctctggagggggtggatctctgaggcctcagcaaattgtcctattggtttgagcaataaaaatagctcaagctggtaccaagtacagataggagatttgtcaaaggtcagggcacctccactcagaattccttcatggttatcaattgtaaaccaaaaagtatgtgagacaggtctgaattgatttagaaagcttattttggactcttactcataggtaattctagtcttcatagaggtatagcagccaggtgcaaattgtgggggcctggaaataattttggtataacagagattaaataatttgtctaagcaatagcttggcaactttgggagccaagttgtaatcctggaaagattaatgcttggcctgagatgtaatagccactcctccaggttgtcttttaatgtgggaagtaagttctagtgtgtttctgtagtgtggaacttttagaaataatattcttgtcacatttgacaatacccatggctgatctagacaaaatatcatccagtcgctgtttagccctgatttgcatatgagactttgtgctggtcatctggtaacttttcactcggcagtggggatgaagtaactgaaactccagaaagaagagttattagatacctcaaaaatgatgaagatattagaagccctggccttaggggtccaaggaagagcaaggtttgtgggtaataatctgtataaatctgataggaagctataaggaggactcttaggactatgaggtgggtgatgattagagcctggattaatcaagggcctgtggcttctaacaccatcagttgcctgtactcagccaccttcagcagtgctatctggctctagagagccatagcattccaggaaaggagagaaggctgcacaaagccctgatgtttgtgtccccccatctagacagacataatagcatgcagggacaaagcaaaagagaagagtaggcagagacaatgtgaatctgttcaccacatattgtaaatgcatttaaaaatattgttagcccatatttgcaggtagcactaattatgaagttgttggactgaggactttatttatttgtgactctcaccatcttcaaagtcagcaatgaagagtttcttcctcattgaatcactaacgcgttttggatctctctgacttcctagtttgctgacctctgacctctagatccagactttaaaggcccatgttattagattagtcaacctttataatctccccattttaaggttaattgtatctgcaaaatccctttgccattcaatgtaatataattatgtaattagcaaccataagaaagctgaagtgacttttaaaccaacccaattgtcccatagaactgatgtttacggtttcttttgaataaacatagaaattgaccctttcagtcttgaaatttgagaaagttacatttgcattatctgagttcctttctcaggaaaccaagcgttgggccctccagatagtatcaaagaactgaaatttaccagagtaccacatctggacaatgaaatatcagaccccttatcccatcaaaattgcctaagtgaccacctgcttcctgttgaccaattcctctttcttacctctccctaattcctgttttcctgcatgtagttccatttcttccctgctatctaaaccctgaattttcattggtcaggaagatggatttgagactgatctcccatctcctaagttgtagtacctgatgaaagccttctttcctagcaatgctagttggctcagtgattggctttctgtgcagtgaacagcaagacttaaatcaaacctctggtgtttcagtagcaactatcctaataccagacaaaataaacaagagactttaagacaaaaaaagttactgaagacaatgagggctattttgtaatgataaaagggttaatccatcaggaagagattacaattataaatacacatgcatctaatagagcctcaaaacacaggaagcaaaaactgacagaattgaagggagaaatagacaatttaacaatagtagatggagactttaataccacaactttcaataatggatacagcaactacacagaagatcaataaagaaataaaagatttaaacaacataacctaccagacatctatagaatactccactcaacaaaaacagaatacacttcctctcaagtacacacgggatgttctatagaatagaccatatgttagcttttaaaataaatcttaataaatttaaaaggactaaaatcatataacttctgatatatctcataaactaatactatcacacactatagtttcaggttagcatgtagggtatgcagtttgttggtcctgcttccttctgtttgtcatgaatgtggaggtgaccatgattacacatgtgtaggccagtagcccaggaaagtcaggcagctgaagggaaaggacagatattccataagagtctccctatctcagtctcaaaaaaccagggaggaattgatacataggaagtgaagagttacatcaggggatgacttctcttctgcctatctatgcctgtctttaaaacctcagtttctatcccactaaaccccattgcacaggaaaactgttgatcaccgccaaccaccagactcattaacttgatttttaccatgctttgtctgagaatatatcctcaggccaatgcaaatcattagtgttccataaaaactgcttcaaacacataaaatagtaacagtttataagtcattccaaattaggtggcaactacatgtatttaaagagatatacataaattatttcagcaattgtgacaaattggaaagaaagcatgtggagttagaatgaaaatcataagtgacaagcacaaaatatgtatacagagattataacactaagcaaaccacacatagaagaggagagtggggttaggagttatgaatatcaagcttgtcctcaagttaagtgaaaagccagcatgggccaggtgtggtggcttatgcctgtaattccaatactttgggaggccaaagtgtgagaataacttgggcccaggagtttgagacccacctgggcaacatagtgagaccccatctacacaaacacacacacacaaaaacacacacacacgcacacaatagctgagtgtgatgacatgtgcctacagtcccagctattcaggaggctgaggcaggaggatcacttaagcctcggagtttgaggctgcagtgagctgtgatcatgccattgcactccaggttgagcagcagagctagaccctttctattaaaaaaaagcaaaaaaacaaaaaactaacatgcttccccagtgggggaaaagatgtcagtataacattggtttgcagcaagaagtatattaagatattgatcaaaatccttttattatttattttgtttttattttttgagacagggtctcactttgtcatccagaatggagtgccgtggcatgatcttggttcactacagcaaaacacacctggacccaagcttgcagtgagcaatcatgtctcactgcaagctccacctcctgggttcacaccattatcctgcctcagcctcccaagtagctgagactacaggcacctgccaccacacctggctaattttttgtatttttagtagagacgaggtttcaccgtgttagccaggatggtctcgatctcctgatctcatgatctgcctgcctcagcctcccaaagtgctggaattacaggcatgagccaccgtgcctagccctatgcctggctaattttttaaatttttttgtagaggcagggtttcgtcgtgctgcccaggttggtctcaaactcctgagctcaagtgatccaacaaccctggtctcccaaagtggtgggattacatgtgtgaaccactgcacctggcctctaaatcgatataaatcaattattcacacactgagaggaatattcaggatttttttcttataatataaatgatgtgaaaatctggagaaccaaagaagaatgccaagactatctaaaagtgttaaatttttcattaggaagaaaatgacttcatgatagtaattaagacagtgatagaacttggggaaatatgtattccttgatgttttctatgcatttgcaataataaacaatgaaaatatggttgaattttagaaagagataggcctgtggtattgtcacaagggtatacaaatactgagattgacttgttgaggcagtggtctccattggtggtgaccttcagaagagacctgtgtttccacatggcctagacacctggaaggcagagatcctaacattccatgacacccccaccttctaattctgattgtgactccagaccattacctggcactgggtcttacctctggcattcctatcagagcctgaaccacagacagtaccttagagtctaagcttaggtacctttgtcttgtttttgtggctaaggattctcagagttgcgggatgctgatgaaatttatcccaaaagtaagttatgaatcagatctgctttcttttgactcatttaaatcctttgtttaatgtaaagaaactttattgaggtataatttacaaactataaaatttacccattataattgtacagttgaataatttttagtaatttacccaagtagtgcaaccattaccataatccatgcatttgtttttaatttattatttgtctgggttctgattctacttcctcaacaagctacagcatggcagtatctgccaccacttgttttggtccaagggcagaaatcagtatcctggaaaccaatcagtacttgcgctctgaactggaaaagtgcaaacagaacttccaagacctcacagagaaattcctgacatccaaagctactgcctactccctgaccaatcacctgcagaaatatagtaggtcccaaaggggcatggtcaccaaagtgataaatgattgcccatctttcctctgtgaaatgaaacactgcggactttattctctatcaaaattaattttatgctaactacactcccagaaaggtagaagtgggccttttactctcaatttgccaaggacagaaaaactgaggcacaaaggtgtaaagtttgcagggcgagtgtagtgaggaatagagactaaaaccttggtttaggcctgaaactgtctttcccctctcagcaatgaatatcagattctacaaacatgtaacatcactgttggttaaaacatctcaggattcgatttaaacttttttaagagcgcccatttgcaaagcactgtgccaacagcatcagggatgaaagaagtaatagtataccctatctgccttgaaggaacttaaaactacctattctcaactgagtcacagatatgtggagatgcaaacttcaatagcagacacggagaaaaatctttatgatacctggatcaagattctcttcccacataagttcagataagccattcctcatgctctggttagattgagggtatttccagaaaaatcagagactttgtaacaccctttctgtctctctctgagtatcaactttacagacagcaagcaactgcaggtggacatccaggatcagagctatgagacatatggccaaaatgagaacaaggccaagtggaacagactgccattctcaatagaaggccaggccaggttaggggctggccccttcctctccacagttagctctcacatttttaaatccactgtaaaatcccaaacatgttactaatagtcagggaagggaagctgtaatgacaaggaaacgtgggaacaagggcatgagaggaacagggatattagaagaggattctggttaacatagaaattgagtttgttttccaatttctacaattattttaaaatacatcattgtgtgggggtggctaaaagttgctgtctaacttactgtcatagaaaagtaaagccaaaagcccacttattaaagaagtgaaaagatgagctttggtgtgtggaaaaactagtttaaaaaaaaaacccttcactcattataattgtaggaaaaaaatttctcaagctagagaagaagaaagatattacctaagaccctaatataaaggtattattgtgcagtgattaaagagcatataccctagggccaaatttcctgggttcaaatctaacttatcatcactgtccctcagttttctcatctgtaatggtaatagagtaggaactacctctttggatggtggtgacgatcatatgatgataattcttaaaaacctactgcaacagtaccgtgacaaacactatgtgttggttttccctttaaaacaccacctactagcttttgggcatatatcatttggatctttctcctctatatacagttttacacagctgtatacagataaatgtttaaatctttgaaatattttgggattattgaaactcctgacacaggagggccatcagtcctaccattcttagtatcttcccaaacacacaggaagtcattatttcatgcccttatgttcatgttttacttaagaggctgtaaggcttggtaaattggccttaagatttgaagtcatggctgggtgcattggctcacttactgcaatcccagtactttgggaagccaaggtgggtggatcatttgcagtcaggagtttgagagcagcctggccaacatggtgaagccctgtctctactgaaaatacaaaaactagcagggtgtggtggggcacacttgtaatctcagctacttgggaggctgaggcaggagaacaacctgggaatcagaggtgcagtgagccgagattgtgccactgccctccagcctgggcaaaaaagtgagattccatctcaaaaaaaaaaaaaaaaaaaaagaaaagaaaagaaaaagatgtggcgtcagatctcaggggatgtgaattctgactgcctcattccagttgaatcatcttgtcaagtgattttatcaacctgtgggcttttctttcctcatctctaaaacagggagtagttgagagactgaggaataaagatatggaaatcccagtgtaaagcctcgtactggggatacttttatccttgagatagaccctgcctcctgctctgcaagcagtgaccacagcaacatggccagccttccatgatgcaggcatgtctgtcttttctcagagtgtgaagagtgcaaagaccttatagaatctgtgctggaggaggaggtgcagtttcaggagagggagctggccgaattgccgaggtcagctgcaaggctccggtaaggaggtacctctgtgggaagtgcataaatactgtttgaagcagggcagctcaggctggtagaacaaagagcaaatttgtgcaaggagaagggcagaaatgtatgactcaggcacagaactagactaagacacaatgaggctatggtctagttaggtctctagggttttccattaaatagcatattagtaaaatggagacagctgcctgcattggaatactagcaatgtggcttctatttgtgtgtccttggtcaaatttacttcacttttctgcgtgtcattaacctaggctacctcatttataaaatgcaaatactgacagtatctactcagagggttatgaagattaaatgcacaattgcaagtagttagaaccatctctagcacatataaaactctgaacaactattttctgtaattattatatttgttcccatttatagatgtggtgattgtcattaatattttctataagagatattttcaaactttccaaagtgcctttcatgataacaatgtttctcctccaaactttttaaaaaagtattatactaggtggagtattaactggtagggctattgggtagatagatgattgagcagctgttgtgtggaaaatgaattattaattcgctcaggaccagcattgactatccttagagggtttcagacataaggtagattgtagcattcgaaacttcttttaatcctttgttgaaatgaaatcatagaagctcaaatttctaaaactcaccaaagcagagatatttgattgaaggtgggataggtctggagcccctatttctccccagtatgtctttacttcccctgacactttctagtaactctaagaaatagagtttgaaagaggacctgcagataactacttagaagactggtggggagaaaattcaagcattagatgggttagatgactgtaaatgttcagtctagctctgggattacatggttctaaacattaactgaataactacttgtatgtgtacatactaccgggtgctgtaagttgggtaataggtagcactatctttagactcacagagctcacactctacattggaacccatgtgtattagtctactctgacactgctataaacatatatctgagattggtgatttataaagaaaagaggtttaatcggctcatggttctgtgggctgtacaggcttctgcttctgggcaggcctcagaaaacttacaatcattgcagaagtcaaaggggaaggaggcatggtcttcacatggccagagcaggagagagagagagagcaaagagggaggtgctacactttcaaacgaccagacctcatgagaactcactcactatcatgagaacagcaagggggaaatccaccaccatggtccagtcactatccagcaggtccctggttggattacaatccaacatgagatttgagtggggacacagagccaaaccatatcaccatgagaaatatttaaacaataattagaaaaaaaataaatccccacagagtaatgaaattactactcagaactttactttttttctttttttgagatggagtcttaccctgttgcccaggctagagtgcagtggtgtgatctcagctcactgcaacctccacctcccaggttcaagtgatcctcctaggtcagcctccccagcagttgagagtataggtgcacaccaccacaccagctaatttttgtatttttagtagagatggggtttcgccatgttggccaggctggtctcaaaactcctgacctaaggtgatctgcctgccttggcctcccaaagtgctgagattacaggcgtgagccactgtgcccggccagaactttagttttaactgccttcttactgattatagtctatcttcatgtcattcagaagaacactgcccctcttgaccttttcactgatttttctttttaactttcaattaatactagggataccggcccaacagttttgaacttggcttttttttttttttttttttttctgccagttactgcatatgaaaagatacttgggctaaagtggggaaccaaaggggcatctttttaaaggaaatttagtaaaataacagacaaacccaaggctgcctcttcattccttctgccacaggcaagtcacacaacttgtacaagaattcatcttgggccaggtgcagtggctcatgcctgtaatcccagcagtttgggacaccgaggtgcatgaatcatttcaggtcaggagttcaagactagcctggccaacatagcaaaaccccatctctacaaaaaatatataaattatcctggcatggtggtgggcatctgtagtcccagctacttggaaggctgaggcaagagaattgcttgaacctgggaggcggaggcagaggtggaggttgcagtgaaccaagatcacatcactgcactccagcttgggcaacagagtgagaccctgtctcaaaaaaaaaagaaaaaaagaattcaacttgggagttccttacagggattctaagagatctctcctctgaaacttctataacctgttattcactacattccctcatacattttactcttctttcccaccttaggatacatgatcccttaattcaggctcaggctgaagaactgacccacttacgacagaagacacaggaagggagaggtgtctgctacctttttacccagcatgtgaagaacacagtcaagtcttttgagggccttctcaggaacactgacattgcctactaccagagacagagattctgtgagcaaatggtacaaggaagccagctgacagagatccttgtcagaaaacttgccacaggtaagttggctacaggctctgaagacccttagctcctcccaagtgtcccaaagtggggagaaaaaatgcaaacttatctccattgtagattttattttagttttgactatggtccttaatctgcattctattgttttctctttagagcactcaggtaatcacttttcatattctttcaagaattctaagttttgttttttattttgagacagaatcttgctctcttacccaagctggagtgcagtgacacggtcttggctgactgcaatctgtgcctcctgggctcaagcaatcttcccacctcagcctcccaagtagctgggactacaggtgtgtgccaccacacctggctaatgtttgtattttttgtagagatagggtttctccatgttgtccaggcttgtcttgaactactgagctgaagtaatccacctgctttggactcccaaagtgctgggattacagatatgagccactgtgcctggcctgagagttcttagtttcaatcagtaagagaggtagagtatagtggattacttcatcttgatgagcataagaactcaccttcatttctggaagatgttttcactggatgtaggattctagttgacagtttttgttttaaaaaagtgtttgaaaagtgatattccgctgtcttctggcttacactgttccaacaagaagtctgccataattcttatttctgtttctctgtacataatatgtcttttttctctggatgcttttgagattttctatttatcactggtttgaagcagtttgattaagataagaccttgtatagttttctcttttacatattgttctactttatttagtttcttgcatctgcatgtttatagttctcatcaaatttgaataataatgacatatatagtcttacctatggcatatacaatatattatatttcgcatatatacggcaaatatatataatgtatattctattctttctctctatcttctcctttaaagactccagttatatttgtattagctgctttgaaattttaccacagctgactaatggtctgttcatttttgttgtatcttttctttctctccgtttctttctatttccatgtcttggaattgattaatctttcttcagcagcatctaatctgctgttaatcctatccagtgtattttcatctcagactttatttttcatctaaatttaatttatgtcttttttttaaggtcttctatgtaactcttcatcatttcatattttcctctagcttctttattttattttattctattttttgagacagagtctcgctctgttgcccaggctgaagtgcagtggtgagattttggctcactgcaaccttcacctcctgagttcaagtgattcctgtgcctcagcctcctgagtagctggaattacaggcacatgcctccacacccagctaattttcatatttttcagagagacggggtttcaccacattggccaggccgatctcaaactcctgacctcatgtgacccacattggcctggcaaagtgctgggattacaagcatgagccaccacactggcctagcttctttaatacaaggtatacagttatatttgtttcaatgtgcttatctacagattctctcatctgtgtcctttttattgttttttaattctcacctgatgtgtcttttctaagtcagtttaagtagattgatttttttcccccttcttatcatggattacagttttctgtttctctgcattcctaacattattttatttggggttagacattgagcattgtaacttattgggtgctggatttttttgcattttgtgttaaaattctttgagctttgttttggtatacaataaagttacttaaaaacaattttcatctttccaagctggctttttaattttttttaggcaggataagagcagctattagtcaactgctattttctttcccactatggaggcaaaatgacctttaagaaaatagaccttattttttagagtagtttcagattcacagcaaaattgagcaggaagtacagaaagttcccatataacccctgcctccacacatgcatagcctcctagactatcaacatctctctccagaatggcacatttgttacagttgatgaacttacattgacatgtcattatcacacaaagtccatagtttacattgggggcaatactcttttgaagattctaagccagtgatctcccacagatttggcaccagggactggttgcatgaaagacaatttttccacagacaaggtgggggtggggtggtaggggttgggaattgggtggtttcagtatgaaactgttccacctcagatcatcaggcactagttagagtctcataaggagcatgcaacctagatccctggcatgtacagttcacaatagggtttgtgctccaatgctaatctaatgccatcgttgatctgacaggaggctgagctcaggcggtaatgctttctcgctggctgctcacctcctgctgtgcggtcccattcctaacaggccatggaccagtgctgggggtttgggactcctgttctaaccaatgctccctctattaaaagggattttcacactagctgatggaaacaccaagtgttgcaagctctgtgtgagctacagagattattccttttgggaagttctttgccctgctttgcataatttcctcaaatacatgtactaataagtacttagctgaagattgaacacagatatccaaggcattctctctgtgcagcaacctattctctagtctgtcctgtgatgtctagccaccctgacttcttcaaacttactaccaggctctgcctgggtcctccttccctgctctgcagttgacaaactcaggcagcaaactggagcactcatagggctcatctcttctattttctctctctcagggatcaatgtactgtactgcactatatccaatgttgaagctagagtttaaaatactttttccagtttcttagttgtttaaggtggaggacaaatctagtccctattactccaacttggccagaagcagaagtctccattccatctttgtggtcagaaagaacagtatgacagaaggcagcttgttagaatagaaagatccatggactaagaatcagaattacctaggctctagtctcagcactgtatttactaactttgtgcaagtgattgatccctcctgaatttctgtttcctcatttgtaaagtgagtcaaatcataattccacggctgctgtacagatcagttgaagtagtatcttaatgttcatgagtgtatttctctttcagggttatttatttatttatttattttcaggtcccaatagactgtccaaatcttttggggttagttcaggctctgtatatagtagaagctggtgttagaaaagttgatttataccggaatatttttcatagaatcacccccaattctcaccaacaaactgagaagaaaaaaaaaagaattacccccaagaacatctgaggaagcacaacagggacagacttgaaggtacctgggcagtcctctggttttggagtagaggtaggacagggctatttgtcctctcagagactggagcaggttctgtgtgtgagtagctatgggacaaacagtcatggtctggcaaacagcctgtggcaggaaggaaggttacaactggagaagtccaaagggcagccaggcaagtattctttgagctggggaacaaaagacattttaaactttttgctctgcttcaggcagctgatgtcatggtgatgattcaccacatcaggaacaccctgtccagtgggctcaggcaagcctgccaggccacttctctaaagacaccacctgaggcctcctgcaataaatctcacagagtattctgaacacacatgtaaagtgttatgtccctgatcatataggccccatgtgtgcaatgtgtgaaatgggacttgcctaatttctgactagctctttctaattttggtttgcagaaaatcacaacggtaagaaaaatgaagacaggcaaaagccactggctcctaggtaactctatatgatgaaggggctgataatggactgaccaaatctagagaggattccagaagcaaggactcaagaggttaaaggtcccagatatagaaaaagcagaaactgctgattgttcctttttttgttgactgattatacaatgtgtccttttaaaaatggttctctgttctctttgcagttcttgtattggttcctagttcctactaatttctcacacttagttaactagtcagtcttactgaaaagtaaactaaccagggatccctggtttctgtatctttcaaacctatagggttacaaaccaaagtgagatgcctatctggtttctgcacagttgtcctgaattatgttggcagatattttatacctagaaattcaccttgaaaaataaattgaaaccataccaagtatttagagctaggggtctaaagtctgcaaaagccctgggaggttgcgttgtctcaagagccagtattcaatggaccactccacatcatagtaaataaaatttgaacacagcattttgaagccaatagtatgggtctctgtgtgtcctgtgtgccctgagtgtattttagagtagctgttgagtctgctgccttatctgtgtgttatgaggtcaatgcactgatcacttgctgttttcacttctatactaactctaggcacactctactcccggtcaaaagtggattgtatatgtcctctttgatgtgatggtccctttggttttggtgcctcttccatgagcttcagatcagaactagctatgtggttccaggctgccttggtttcatcccttgtcttgcctacttcacctggctcaggagggacatcaaggaggaagaaatggataaagtcctggagggacttcaaacagtatttgacccattccagccgccatgactcccaccagcttcgcagcagcaatgccttcctctttgatgcacaggaagacccctctgctctggatatagccagtgagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaagtctcaagtacaggtccctggtgggtcaggtaatttgctctgttcctgtcctcacctcagtccctctggccccaactggcatctgcaagccagtatactcaaagctggccagaatgaagagagtgaagagattatggcagactctctgccactactgccacacatgtacaaatccgcttaacagatctccttctttaaaatgggacatcttatctttcctgaaatatatatattttttgagacagggtctcttgttctgtcacccaggctagagtgcagtggcatgatctcggctcaccacaacctacaacccagggtcaaatgaccctcccgcctcagcctcctgagtggctgagaccacagatgcatgccactactcccggattttttttgcctttttggtagagacagggtcttgccttgttgcccaggctggcctcaaactcctgagctcaagcaattcacccacccctgcctcccaaggtgctgggattacagatgtgagccaccacacccagccttcctgaaatattcttgataattatagttcctgaacagttttcccaagctgttctagccatcccaagaatgttggcaggcttctccatatgtttggaggtgtaactataatggttcctgggtttcaagctccagtctccatctcccctcaggtgcttgctttcccataagtttccatctgactactagaatatcaggggatttccataaagacaagactttgatcttggcaaccctttggtaaatagccagggttctcaatctttgtgcagcaccaaggtatttttaagatctctgttagtttagtctcagtgttgtaattcaatctaaataaacaacgaggctatctgctggagaaaaggatgaatctaacagcaatgccaccagcatgccctcttcccagaaaaactccacgctagccattggagcttctttaggtatataagagccctttaggttggtaacctcactggtgtgtgtatagattaaaaccttgacctatatctcctctcccttacttgaatgtttgactttactttgggggcaaaagtttggattgttaggggactatatgctttatatactcttctatgcaatagaaagagattgtattaattcactcattgagctttcacagtaatataaaccatattaggcttgtcattctgtcagtgatgggtgtaagtttgtggcttttattactcataccatcctctgacaaaggcatcctatttctctttccaatttcacaataaggtgcagaagaaggtctttaccatctgttaaagatgttcagggccgggcatggtggctcacacctataatcccagccctttgtgaggcctaggtgggtggatcacttgaggtcatgagtttgagaccagcctggccaacatgctgaaaccccgtctctactaaaaatgcaaaaattagccaagcatagtggtgcatgcctgtagtctcagccacttgggaggctgaggcatgagaatcctttgaacctgggagatggagtttgcagtgagccaagatggtgcctctgcactccagcttgagtgacagaatgagactgtcaaaaaacaacaacaacaacaaaagatgctcaggagagatgttttgtagagaggaagatattccctagtacccataaatcatctcaaggaggtggtcatatctttcctagtgctagaaaagccctattcagaaaccttcagtgtttttccacctcctgtcaacctgccttatacttcctgtatctccatgtgggaggcatccctgtggagtttgcttagcacttggccatgctttgtttgaaaccttaaaagctcttaaaggaagttgccttatgttccctgatgagaagatgaagttggcaaaagaatggtgaaaggcagggatcttgatgagaggcccctgactatccctttagtgatcagcatcttcatttcccgtctcattccatgtcctggtggaatggctgcagaagatgagatccagagacagcggtagcacctgaaggaaacccttttcatcaacaactgcctgtgagaaaagctggaatgtcatctcagcagctttgatgaagaaaatggtgggagaggcccaagtcagtgcttctggcaatatgtatttttctaaaggcatgtgactggggcagagttttatagatttcaagcactttgacatactttacttcacttattcattacaaatgtcccagctagagaggtagggcagctactatcattcctatttataggtaaataaataggcttaaagatttgcctccaacttagaggtatctacctctaaaatcattcttgtgattcctaggctgtcttctgtcttctatctgctgctgtacactgcctgctgtctctctgcttcttatgtgattggcattcagtagaacccaggtttctgagcacctcatgtagcagaatgagagtctcctctgctgccatactcatcagcttcccttatgtctcggttactcttcattctaccaccccaaggtggttctctccaacccccctcctcttagattgttctcacacagaggccatcatttcataacattgtgctgggccggaagaaccataaccaggtcccttcccataccaaagcagtaactattttggaaaagcctccttcatattgcagccattggacatgataatacatgtgatgtgctggaatttgttaagaatcatgtgaaaattaagcttctgccccatcgcactaaagttccagccctgagtccccatggttttctccctaggctaagatagagaggaagaacatgaaatatgcagaaagcattctcttaagcaaacgtgtataatttgcctaaattgtaattatttcctggaacagcatgcacctctaaactctacaggcacatcatagattccatcgtccagctgtataatgaaaacagagttctcagagaacaccggagactcccccgacttgcctgaatcaagtttctagaggtaagcggtgaaaatccacaatatgaagtcactctcagacgggtcccttctcttgtcacactccactgtagaaacaaaagaggacggggaagccagagctgctcaaaaccttataacccacaattgtcatagttattctcaacttacacagggctgctttctagacgcaccccctccaggcccccagactgccaggctccaggaataagtagctctgagaaatatagtttttcggtggaagccacactccactattgcaaattggagaagagaaggacaaacttaaaaggtgaaaagatttaagagaacaacatggtgaaaccccatctctactaaaaatacaaaaattagctaggcgtggtgacatgcacctgtagtcccagctactcaggaggctgaggcaggagaatcatttcaacctgggaggcggaggttgcagtgacccaagattgctccactgcactctagcctgggtgacagagcaagactccctctcaagaaaaaaagaagaaagaaagaaagaagaaagaaaacaattgttttagttgaatacattttgtcaagattaaatcaactttcccctagggtactgatagaataagcaatcataatttagattctaacttactggtctttgagaaattgtgaaaacaaaaaaggtgccataagccaaaaaaggagcaaaagtcctaattttcaagctgatgaaaataaagaatgaaaaatattgaaatcgtcatagttcatcttggtccttggcaaaatacaaatctattgattgaaaatataatatcctagctaccttattgtgcctagctcttaccactgaggagaaaaaccaaacgcaaacaaaagtatgttcaaattggcaaaaatgtttacaaacctgcaaaatctcttcagcctatccctcaaactccagacttggtatttactaagctctgctgtgtacaatacccaccttaatatccattcttgcacaagttctgttaggtataagccaagatcacatgggattttttttttttttttttttaccctctcatgcctatgtctgcttttgcttccaaagacccttctgagtaaggactgtcctcagactactggagtcatttagtcacaagcttgcctgaggctcagagctggcaatacctgggagtttatgtcaatcccacagcacccagcaaccttgcctgcaaattatttacccatgattgacaggtgcaggtgtatgaaagtccagctccttgacttgaggggtgcctttgtggtgaattagctttgggaaaagggaatccagaggccaactttgtaaaactccagatagataaatggaaagaaatctttgccttggaagtccagttgagaaagatagtgatttacttcagactgtggaaagagagactaaaatctttactttctcatgggaaagaagcctatggtgaaagagaaacaaagagaatggtgggaaatagggtgggtctactcagtagctttaaaccattctgtcatattataaagcctggtgaggttttaacacaagtgcctggactctacacctagagattctgatttaaatgcttccaggtgggtggaagccactagtagtcttaaaaagctcccaagtaattttcacatgtggctagagatgaaaaggaccatctatctattagaatgtcaagtcgccaacatagaagtgtcccaaatgtacagctacctcatagaaaaggcttaacaccacccattgatggaattttccttcctctcgccatggttttgtttgcatagcatggaaaaaagagaagagaaaaagaggtagatggatagattgaacctataatttgcctatgtagagcagtttctcaaacttatctgaccacaagatgcagtgagaaatatacaattctttgtgatcagtttttaaaaaatctttcattatgtgtaatccaaccttcctagtatttaaataaagcctgtagtagcaagcagtccactatattgatttcacaacccataacttgttcagaattgcaattagaaattttttttggccaggcttggtggcttgagcctgtaatcccagcactttgggaggatcacctgaggttgggagtttgagatcagcctgaccaacatggaggaaccccatctctactaaaaatacaaaaaaaaaaaaattacctgggtgtggtggtgcctgcctgtaatcacagctacttgggaggctgaggcagaattgcttgaaccctgggggtggaggttgtggtgagccaagattgcaccattgcactccagcctgggcaacaagagcgaaattgtttcaaaaaaaaaaagcaaaaagaaaagaaaaagaaagaaaaaaagaaaaaaatttttttcacttctgctcaacctttttatcaagcaaaatctcaaaagaacatttactgtaaaagaacattgacaacaaacatctttctgtgaatccttatttctgtcccagccaccatgacccaataatctctagagcctgttagtgttctccagattgaagccttccctctaactgctcctaaatctgtgatgtagtggaaaaagtttgaggccttgattctcatcccaggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttaggagggttatttctctgcaaactatcctctctttcttatgacagctatttctgaatgtgcacatttgaggctaagcaaatcccttcctgggaggcgtgaaagacctttatttctctgcagaggagtattatggaaagtcagttgatgctgaggaggtggtagagacctagctaactcatctgcagcggctttgagcaaggcttttagaatcataaggtggctggggtcctgtgtcctacaccacaggccagctagttcatttcaggagactttcttttctatctattattactatcttcttctagactgtagttcactaccagagattatccacttagctgcactcagtttgcacctggcctgtatcaccacttagctctcactccagcctcagttaggtatcagcaagacctcaccaaagattattgtttcattgtatatgtgtgtgtgtttttgtttgtttcaggtaacaactgatgttggaactatgaaaagctcttctctacttttaacaaagcttagtcacaaacagttccccagttgacgagaacaactaaaacaacagaacaattgaaagtccaaatttgaaagctccatctccgagaagcaaattttacagccactccagatttgtattccaaatggatagtttgattataaaaatcacatcccttcagcctgcaaatgtgataactgcccaagagacagtgatgcctacatccatagataatcccctttcccccaacctatatataactggagtcaacagcagctggaggaaaatggcaaggacttgtaatcaagattaagttagaaaaacactgctgtagactgtttatcagctcttcagcatatgtccgttttccttgaaggatgagcgtttagaaacctctgacaataaagtttattttacacacattctcttgcctatcatttttttttgtacaaatcacaattataaaactttcttgctccagctaaaagcaggaaactcagtcacaaatgtgttcactacatgtataccacagaatgatagcaaccagtctgattgcatcacttgattccaaaattaaatgttagcactcagtagtgaaactacatgtatctccaactctggaagccacaggcaagatactcctgtttcctgcagggaaacagatctataagcagggcagcagtctcacacatgtacactcctgtgaaatccaaggaaataatgatagtgacacagggcaggcaagccccaaaactggtttgtagcgtgggaaatttctcccagactgtagtctccttggctttgccaagaaaagaattcaaggataagccgctggtgagagaaagcaacttttattgaactggtgctacttcttgcagagcagggctaacctataggcagtgtgcccagagttggtgcctgtgggctactagctagttgtatttagagccacttttaattgcatgccaattaagaggtaggttattcagaactttctgggaaaggggcagggagtttccagaaccatataaagtaacttccaggccattgccaaggtgtgttgccatgacatttgtaaactggccatggtcccagtggtagtgtctttatgctcataagcagtgagggcaactagaggtcactttcatcatcatctgctggtttcagcaggcttctccactgcaccctgttttgaccagatcctgctctgttcaatggggttgggaatggaaaataagtccttctggtctcctacctcatttccccatcagagattatatactcctccttaatcttaaggggcttgcagaagggcggaggttcatcttctgtaactgcttcctgctgatgttatgggcatagaccctgcctagcactggagaggtaaaatccctggatacctgttctaaaaggctcaaaggtaggatgtctttatcttctgggtcagaagaggggatgggttgaaagccttgtgccagcatcatctttacatggaattattgtaatctggaagacacaaactttacaaggaggttaaacaagcaaagagcaaagattagtaataaaaagatatctattaaaggtcctaggaagggtaaaaaccaagtgtctgctggtagagattcctttactgaattccatcagcagggcaaagcagtaagagggaaaacattataattaggaataagagaaaaactttcatgctcatccacagcatcatgttattattgttatctgtgcatttgcaaaacaatagctttaagtcttccgggcgtttgcaaatataggtcacagcatcgtcctctgacatctgtgaggactcataacaatctttgagggccgggggcggtggctcacgcctgtaatcctaatactttgggagactgaggagggcggatcacgaggtcaggagatcgagaccatcctggctaacatggtgatatcccgtctctactgaaaatacaaaaaaaattagccaggagtggtggcgggcgcctgtagtcccagctactcgggagcctgaggcaggagaatggcgtgaacccgggaggcagagcttgcagtgagttgagatcgcgccactgcactccagcctggggacacagtgagactccatctgaaaaaaaaaaaaaggatctttgagcctgggcatagtggctcatgcctgtaatcccagcactttgggaggctgaggcaggcatttcacaaggtcaggagttcaagaccagcctggccaacatggtgaaacctcgtcgctactaaaaatacaaaaaaaaaaaaaaaaaaaattagtcaagcatggtggcacgtgcctgtaatcccagctactcaggaggctgaggcaggagaattgcttgaacccagaaggtggaggttgcagtgagccgagatcgagccattgcactccagcctgggtgacagagcaagatttcatctaaaaaaaaaaaaaacaaaattaactttgaagtttaacagcagtgggggtgcttaataatgcctgataggggccctttccattttggttgtaattgattcttgggggattcttctttctaagtttttagtaagactaagtatcctggttgaatgggcgagtcaatccttttccttgtgggaggaggttacgtttcacttccatatgattgaagggccttttgaacctggcctaagttgataacctatgtatctcttcaacaaacagaacgtctaaagttaaaaagggccttccgagctgctcaggcgacccagcctcccatcgctgctgctctagtgttcggttggcctgggccacactcaactgtagggagcccaggccaagaggcagcctgggccttctgcattgcgaggcgccgggcctcccgcagcgctccgctgacgggctgcgggcgggcaggcgggaggcctagtgtgggtcgcggtcgtggcccccgccgccggccctggccgccgcatcatgaacatagatgtggagttccacatccggcacaactatacctggaacaagttgccggccaatgtgagacagtcattaagtggagatggctcatcatggaggtcttcatccttgtcttcacaagtaggctgaagaggaggaaatacaggatgtattggtcttgctgttcagggtggtagaggaggaagaaaatcccagtcgtctttgaaattcacagagaatatgaaaagcaggttgtcctgtacagtatctgcaatcagttacgatacagaaataacttaaacatgtcaagaaagatgaatgcagatactatgaggaagtgctaaagtacagccaagatcatctcatgctgtacccttaccatctatcggatattatggtgaagggcttgagcataacaccattttcatattatactgggattatggagaatattatgaacagtgagaaaagttatgattcattgcccaattttactgctgctgactgtctaaggcttctcggcataggaagaaaccagtatattgatcttatgaatcagtgtagatcatcaaaaaaattcttcagaaggaaaacagcccatgatcttctaccaataaagccagtggaaattgccatagaggcgtagtgggtggtgcaggctggatatatcacataagatgacatcaagatacacactttgcctgagaaatgtgcctgagaaatcagcttcatcggcaactgatactgatacaaatagtcaagaagatccagctgactcagccagtgtaagcagcctgagtctgtctacaggacacacgaaacgcatcgcattcctgtttgactccagtcttactgccttcttaatgatgggatatctttcaccagttcagagcactggtgaaggagaagcacagaggtattttgatcatgcatttactctgagaaacacaatactgtttctgcatcataacaaagatctagttgtgcaaactgcacagccagaccaacccaattatggttttcctctggatctcttatactgtgaaagccttcttggtctggaccctggaactttcagcagagttttaaacaaaaactacacgctgcttgtttccatggctcccctcaccaatgaaatccggcccatcagcagctgcacccctcagcatattggaccagctatcccagaaatcagctctgtctggtttaaacggtacatttatcatatcactggacaaggaccaccatcccttttattgtccaaaggtacaagacctcaaaaactgccagatatatttcagagttatgatcgattgctaataacatcttggggtcatgatcctggagtagttcctacctcaaatgtgctcacgatgttgaatgatgctttaacacattctgcagttttaattcaggagcatggtctgcatgggataggagaaactgtccatgtcccatttccatttgatgaaacagaactacaaggagagttcactcgtgtcaatatgggtgttcataaagcattgcagatactaaggaacagtggacttacaacatctctgcggatatgtcaccatgttgaatgtttccatccaacttgcaaatagaaaactcagtgatgcttctgatgagagaggaaaacctgatttggcttctggctcagatgtaaatgggagtacagagtcatttgaaatggtcattgaggaagcaactacagattcagcaacaaagcaaacctctggtgccacaacagaagcagattgggttcctctcgagctgtgctttggaattccactgttcagttccgaattaaactggaaagtttgtaggaaaattgcgctaaataacttatcaaaaaaaaatcattcatatttaaacatcttctcaaacgtcagcccattttctggcacaaacaaggaagcagttctcagtgatactatctgtccaaaatcaagtgcactcaaaccatcattttcttgtttgagtagcttgggctaccactcaaccaataaaacatcataatgttcttaattttctaaactgacaaggctatataataaaaggtacaaaatgtatataaccactcatcataggtaagtggcggattttctttcagtaaaggatttaaatactattatacttcaacagtcaagctagacttactttctaggtcttatattaatgttaattgagaactttcataattacttcctatataaagatgagaattatctgactttgaatttctatcatattagtatatactttaagtcataattgtgagtttgaaacctacatcaataatactatataagttctaaattaattgtaaaatattgtcaaaaaaattaaaatatttacatatcattatccccaccatatgcattggaaagagattattctttatgacatattctggtatatttcccgtgaatctctatctcttgtgaagtttcttcttatgcaatgcctggtcaccagggatctgtgaggttcatgatagaaatactaatagcagttactgaagtctgagctgacttgtgtgttgcagatgctgtgtgtcagagtgaagtattcttatacagtaaagtacatttacttacttaagtccaactgttccctagttttccaaggtcaaggaaaaaaatgagttataaaatggaaatggaaaaactctctctggttggctttgtggttattgcaccaatatctatttcttagaaattttcctgctagccaagtacagtggctcacacctgtaatccagagctttgggaagccaaggcaggaggatcccttaatcctaggacttccagacaagcctgggcaacacaggaagacatcatgtctacataaattaaaacatagccagtgtagcggcacacacctgtagtcccagctacttgggaggttgaggtgggatgatcatttgagcccaggaggtggaggctacaatgaggcaagattgtacttgatacggtttggctgtgtccctatccaaatctcatcttgaatgtccatgtgctgtgggagggaccctgtggaaggtaattgaatcatgggggcagttctttccggtgctgctttcgtgacagtgagtaactctcaagagatctgatagttattatatgggggagttttcctgcacaagcctctttgcctactgccacctacgtaagacgtgacttgctcctccttgccttccgccatgactgtgagtcttccctagccaggagttcaattaaacctctgtcttttgtaaattgccaagtctggggtggtctttatcagcagtgtgaaaacagactactacagtaaattggtaccagtagagttggggctgctgaaaagatacccaaaaatgtggaagcgactttgaaactgggtaacaggcagaggctggaacggtttggagggctcagaagaagacagaaaaatgtgagaaagtttgggacttcctagagactggttgaatggctttgaccaaaaacctgatagcaatatggacaataaagttgaggctaaggtggtcttagatggagatgagaaacttgtcggggactggagcgaaggtgactcttgttacgttttagcaaagagactggcagcattttgcccctgccctaaagatttgtggaactttaaacttcagagagatgatttagggtatctggtggaagaaatttctaagcagcaaagcattcgagatgtgacttgggtactgttaaaggcattcagttttataagggaagcagagcataaaagttcagaaaatttgctgcctgacaatgtgatagaaaagaaaaacccattttctgaggagaaattcaagctggctgcagaaatttgcataagtaactagaagccgcatgttaatccccaagacaatggggaaaatgtctccagggcatgtcaaaggtcttcacagcagcccctcccatcacaggcacagaagcctaggagaaaatggtttcatggtccaggcccagggtctccatgctgtgtgcagcctagggactccatgccctgcgtcccagccactccagccccgactaaaaggacccaaggtatagcttgggctgttgcttgagagggtggaagctccaagccttgacagcttccatctagtgttgagcctgcaggggcacagaagtcaagaactgaggtttggaaacctctgtctagattttagaggatgtatggaaatgcctggatgcccaggcaaaagtatgctgtagggggcagggccctcatggagaacctctgctagggcagtgcggaagggaaatgtggggtcagagcccccacacagagtccttactggggcaccacctagtggagttgtgagaagtgggccactgtcctccagaccccagaatggtagatccactgacagcttgcaccatgtgcctggaaaagctgcagacactaaacagcagcctgtgaaagcagccaggaggggggctacaccctgcaaagtcacaggggtggagctgcccaagaccatgggaacccacctcttgcatcagtgtaacctggatgtgagacatggagtcaaaggagatcattttggagctttcagatttaactgtcctgctggattttggacttgcagggggcctatagcccctttgttttggccaatgtctcccatttggaatgactgtatttattcaacgcctgtacctgcaatgcatctaggaagtaactaacttgcttttgattttaaaggctcacaggtggaagggactttccatgtcttgaatgagactttggactggacttttgagttaatgctgaaatgagttacgactttgggggactgttgggaagacatgattggttttgaaatgtgaggacatgagatttgggaggggcccagggcagaatggtttggctgtgtccctacccaaatctcatcttgaatttccatgtgttgggggagggacccagtgggaagtaattgaatcatgcgggcaggtctttcccatgctgttcttgtgacagtaagtctcaagaggggagttttgctgcacaagctctctttgcctgctgccatccatgtaagacgtgacttgctcctccctgccttctgccatggttatgaggcttccccagccacatggaactgtaagtccaattaaacctatttcttttgtaaattgcccagtcatgggtatgtcgttatcagcagcataaaaacagactaagacagtactccagcttgggctacagaaagagaccctatctctataaaaataaaataaaaaatgttcctgctattcaatactacatcgtatcttcttcaggatagttcatttgggaatcgctaagtttacccctgactctagggatgggacatggaatttacacctaaaataatcagcgtctgaaaggacgtcccctctctggatatggaaaaggaagaactgcaggagttgtatgcagctgccttgcaatcccatgggaaacaatgctagctcacaggaaggcaaaagctgactgttgaaaagaaaccaagtccttgaagacattgttaggccccaaaccaatcaacccagaaacccatttaccactgaatctagagttaaataagcaagaaaatccccttttatttaatccagtctgagttgggtattctgtcattagcaaatgaaggcatcctgacatgtgggaatgtcaagacacacaagctcttgtgcagttttccatgcatggggacagtgccctggcattccagaaatcctggcttacttatcaccactctctaatcaactgcaaataacattttaaaactaagtgcaaagagaatgatcaggaatatcataaaatctgcatttatttaaaaaaaaaaaggagcttacagtgaagtagtctcaagcaattgctttctttttttttttcttttttttcttttattattatactttaagttttagggtacatgtgcacattgtgcaggttagttacatatgtatacatgtgccatgctggtgcgttgcacccactaactcgtcatctagcattaggtatatctcccaatgctctgcctcccccctccccccaccccacaacagtccccagagtgtgatgttccccttcctgtgtccatgtgatctcattgttcaattcccacctatgagtgagaatatgtggtgtttggttttttgttcctgcgatagtttactgagaatgatgatttccaatttcatccacgtccctacaaaggacatgaactcatcattttttatggctgcatagtattccatggggtatatgtgccacattttcttaatccagtctatcattgttggacatttgggttggttccaagtctttgcttattgtgaatagtgccgcaataaacatacgtgtgcatgtgtctttacagcagcatgatttatagtcctttgggtatatacttctcaaaagaagacatttatgcagccaaaaaacacatgaaaaaatgctcatcatcactggccatcagagaaatgcaaatcaaaaccacaatgagataccatctcacaccggttggaatggcaatcattaaaaagtcaggaaacaacaggttctggagaggatgtggagaaataggaacacttttacactgttggtgggactgtaaactagttcaaccattgtggaagtcagtgtggcgattcctcggggatctagaactagaaataccatttgagccagccatcccattactgggtatatacccaaaggactataaagcaactgctttctaagtgggatggctgaagcaagagaccttaaatcacttgaccgtcttcacaaaacagaactgaagcagaaccagaagtcccctgatagcctttcagggacaccacctacaaatacaccgtaatccctcatactccacatgccacttcagggaaagggacatgaggcaggaatacaaatatataccatctgtgacacttcctaagctcctggcttcagagtagccatcctgataattattttttaaagtccacattataaatgtgcaagttaagtgagttatggaaatcattccagatactggttcaccagtaacatcagtttagccctaaatattgtcataagttctctgataggctcatgtgatttaagctggtgctctgccaagactagacttaggcgttttatcctttttatgacattatgtatgttgaagagaatatatgaatacattttatatatatgaatatatataaaaccttcattatcacattattctcaatccagcattttctcagcccctgattttcatgttagttcagcattcttacatctttacagattttcatctaagactacatttctactgttttatataatcagcccccctaagatcaacatgtccacattttttggcaaagacaaagcctactgatttcaggatcattcttttcctttttcaaaagcacaaacccaaactgagaaataaatcaagagaaattctccttttttctatgctaatttagaagtagagtctttatttcttttcaaacccaaagagaatcagacatacaatatgaatttatctactttcgcttgctcagactgagaggaaagattaatattttcaggctgttagtcaaaactgttcattcaaatattatttaataaaatccaagaaccagctaaaaagtcgcttaagctaagaaaccttcaccagcctcatgggaaattgtgtacagttttctactagaatagcctataaatgcttactgaaaatgtctaagttcatatcttggtaactaacattttaattcaatctgcagaataatatatgcttctttagtgctaagatatgaatattagaggcattctttcttaaaatttctatttagttatactttcacaaataactataatattaaaattctgcatgtggcataaaacatattttaatggagaaggtaatgtgtagggagtttatttctgtttgctattagaacttatgtttattcttggttaaaaaaactgcactgattacaacatagaaaaaaacaaaagtatgttgtatatctcttacagtagaagataaagagtagttctaaatttagaaaggaaaaataaatatacacagtgaaaatatgtgtcagtgagatgttaatcaaagatcaactattgctgagaccagcaatattaaatccctgcacaattactcatattataatgagaattttaaaaagaaaatatgaacacataacataatgaaggcagaagtcactctcatccttcatctttgtattcccaattcaggaagctggtatagtatcttcattataattactattcaacaaacatttgtaaaatgaatgaataaggaatgaatgatgagaaaaatgataaacatctccctctgtctcctgggagttaactgcactactttctttcaaatttaattaatcctcaatgtccttgtaaaatagccaaagggaaaatgtatttacattactctaaatattgatgcaatctacaaaaagggttaaacaacttcctcaaagtaaataaaacgttcacaatccagctaggataaaaggatttaaatcatttcctaggtagagggctttcaattagagcccctgctgcattaaccatgggaactcatttcactctcttcatgatggagccctgagtgttgctgctaatctgtactctaccattctaatgcttttaaggttccttttcagcccttcctcctcgtaatccacaaatactgagaccaaggcattttttgggtcagtcctaatttcaagcattctatcctgccctccccaaatgaactcacacttattagaccatatgttcctatattagttcaggaagggggaaaaaatgttcatcacacttgtatataagagatcatagaaaaacagtttactaacctgtgaaaataccattcattctctgtttacctctggtccacagctaagcaatcagtaggatataaatgtaccctatgttcactattcagtattcataagtatactacttatgaattggaaatctgacacaacatttacatgacctaattttgaaaatttaaaatagtgtaaggcccctaggcttaattttacaggggaaagattaaaaggacacaagcaaacatatattctctctctgtgctgtgggacactggtaattttttgacttaaaatatttgatacttaaaatgccaaacttctacatttctgcagtaacaaggcagttatcatattgaataccatttctttctctccagtaagtaaatattagcacatgaactgaaaatattaagtgattataaaaaagtccaaataaattcattaaaatttagcttggcaaaatgttagtttcatgttcttggtagaagtccttttatatttatattcaaatgaaatgaacaatttacaagcaaaggaaatggcatcaaatatttgacaccctgcctcccaaggtgtattgattcatgctttttgctcagatctaggtttctccactcaggaaaagaggagaatgtacccatacttgggaaaacaagtttccgatggcacagctttgatcaaacagcaaaattctatccatctatgtattgccatctgacagtatgacaaatggtcccatgtgcgatattcacactgcattgtagtcaaacctgtaagtcaaaggatatgaaataatagtaactacacattaagcacagaagaaaatgaaacaaacaaaaaggttttaaaccaaccaaacatatgtcttattttggatgttctatatgttcttacattctctcaggtcttttgtgtcgttatgaacacaattctaacaagcttgattattttatttccattcacatattacaggcaacaagctgaaaaagtagaacagggtgtagagagacaggacaaagtacagattagggcttgaagtgcccctgaccagtcgacagcaaccacatggaataatgactcatgtgcattaatgatcacactaaatgatatttgttttttacctagtccttcaactgacagcttaaagaacttcaggttgttctgattcttgagtctcctctacaacttcagagaggactttcattttattttggatcaaatgctccacaactagttgaaactggaattaaattttatatgaagttcctagatgatttaaagctgtaagaagaagaataatgaatcataagaaaacttgctgctacagatatcaaaaaggaatgttaccatccctcatgctaatccttttcattttaaataaacaggatctaaaaaaaataatgctgggaagtcctaaccacatcaagaatgcctcagatcagtgacccaaggaccttccagaatggatgaaatagacccaaagctgaattcacctaattttagggccaaaaacccaaaaaacaaaacaagaccaaaaaaatcttcagatactgggagaacaaatctcaattgctcaattgtatcttatgaaaacaatttttcaaaataaaacaagagatatttaagattcattaagttcttgtcatttcaaattttaagaaaaatattttctaatggaattacatatatttatatgattcttctagttatatccatggtaataaatactcttttcagttggaaataaaacccatttgtgctatattattagggaaaatatctacataaattagtttttaatttaactaaagtctatcttttgaattcataagcataaaattttaaccacttgcaaaatttataacacacttaaggtagtcagatgccttgtcaagtagtttaacaaaagtgattttcacctgtttgttttaataacagtgcatcgattttatgaaaatcaggcatgccctcgggtcctaacaaagtatacgaagctgaatggatctatgccaaatatgccagattttactttctgagtctgattttatacttctgtcctctttcttaccacatggcttccagtatcacttacagactaacccttcaaaaggagaaggctaagttactaacatttggaaggcttatgaaagtgaagcatagttatgagccagcaatgtttttatttagggaatgtgtgcaaaccacacacttaagcaagctctggggaatgagagttggggggaatcaactgttttatttgctaattggtatttcctttaaaagatagagttcttccagattttaactgtgttaatagttactctagaaaaattggagatttgtgtgcatatattttatgttgtaaacagacacatacccagagacactgagagagacagacagacagtaaacagaggagcactaaccacaaacggtttacaaatgacctctgtgctcattcacctgtctgttccccaccttgccttttatagcaactatagcaacagccatgagagtcattgtggaaagaaataaaataaaattaaaaaatcctggaagcttgtaaagaatgtgagcaaaggggaggaagttgtgaaaaaaatgaataaagggcaccgatccagagtattgaagaaggcagagtggagagcctagtaatgagtatctggtaccccagtatcctctcccacagaatctgtacagctctccgtttatgacagtttaaacttaatttaaattatcaaacagacactttcctcaaacatataaatgatgaggcagttcattcaggctgtatgtataaagttgttccagccacctttttctaacggcttctctatatcttttacatggagacaatgagagatttgcttaggacaatttgactgtaatttagaagtaggaaatgggaagtatttgtatcttctttgcctaactcacattagttactcaagtaagcatttcttccgttattgcattttcctgattacaagttttatgttttctctaaaacacatatcaaaagaaatgtcctaagcactatgcagggggaagccatgacatttatctaccactgtcagcaaaaacatgaacttagccctcaacagaatatttcacttcattctagtgtcacctctgcgtcacctgcactggagtcaccacttgcctgttgggtaagaccaggatgcaccgctgaaataaaaaggggtcaaacaatacaagaaaagccagtagaaattgccaaatgtatcagaatacacacaggctttctaaggatatggcccaagaggaaggctctagagcccaccctgaaacaggatttttgacttcacagagaaattatttaattttcaataacacaattcaattaaagaaagggaaatacaaggctaaacaaataagaaatgaagacaaaaacccaacctttcaaatctaaagaaaataatctgttttaaagacacagatgaagatcaggaacccaaaacagaagaaaggaaaagcaattaacgctggcatctgataacaacgaaaagtatggagtctggagaatcgctagactctaaaaattataaaggtttagacttggactttgtacactgaagaaaagaaaactgcatgcatttatactgaccaatgtacactattgctgctttttaacttttgtgtatatgtagggtagatttttttttaagtgaaagcaagcttattaagaaagtaaaagaataaaaaggtgacttctccataggcagaaaactagcgtagttttttttattagaaattgttattcaataatagtacatgttacaaataaataccattttaaactgaaaaaattgtagactttcaaatcagttagggtggtcaccctaaaaaagggcatttttttccccttagtctccttgttcatgttgctcacaacaagaaatgggctaatgctatgaataataataacaaacactgccttctgtcaggccctgtgctgaataccgtctgcatatgtataggaaagggttaactcagcaggtcttgtttgcccagactctgtacatttccaagaaaggtctgcctttaggactggtccttggccagctcctggagaatgagctctcagcttttagaaaattctatctgctaagaatagttttgcatgtctcaggtcttgggccacaaaatatcagtttaatcagatggtttatgttaacaagtatgatttatggcaaacatagatctctaatctccatttctctctcatatatctatatttatctatccatatatatgtacctatatatatcaaatatgaagatatgtttatagcaattgcatatacatagagagatagtatgtagtatgaagagagacatagatattattcttcattttagaatgttatcttggtatgtttaaaaggaaaaacttaagatgtgttgcaattgcagtatgagtttcaggtatgtacatgttatgtgtgtgtgtgagagacacacacaaacacatttcaaacatgttttatgtttaagctcaatattcaaacacagaaatataacatctattcttaatatgttttatgtaagtacagcagcagcattattaaatactgtatttctatggtgattgaaaattagtaggcagagaatttttgtaatggttcttaataatttttgtaatagtaaatgattactttttgtttagtatagttttataatctatacatgaataaagtggatatttctattcatatagaaatgtgatttactctcatgtacttatctacatgctaaaaccataagttatcaattttagttctgtgccaaggcacttttactgaataaaaataatcagctaattttatattttcctgattcaaatttatatgcctgtgtaatgttccggggtttttttttttaatttctgtaaatcagaatattcagatgttgaaaaagtctttgccttcagatttaaaagatacctttgaaatgtagcatatcccaaaatgcaacccagaggctggcaatgtcaacatttttctgttttaaaaaacctcttatgaaaactattgccatactaaattttttacttgctgatgacttacagctggaaaggattctgtacatataagacatcaaatattgaggatactggaacttttaaattaatggaaaagaaagtcaacaaaggaagttcatatgaaatcaaactagtaatatgattacaaaaaaaaaagtttaaaatttttcttggccccagtcttatcatttctgagccaaatacaattctatcgaaatcacctgaaactgaaatcaccattctaggctggttttcccataaagatggactgctccaaaaagaggaatcaagaaagaatttggctcacagtgaattattcactttgtcttagttaactaaaaataaaatctgactgttaactacagaaatcatttcaaattctgtggtgataataaagtaatgaccgcttttcagctggagggactaacttttttttttttttgctgcatatatagctgtggtacattttaatgtgaaatgatgactgcatcagcttatatccatggagcagattttagcattcagcttgggtctcccagtcaatatctacgagtctcttcttaaggagatcgatgacacagatacatacagactaataaatgtgataccaataatcaagaattcactcagttaagattttgcccactgagttccacacaagaaacctagaatttactagattcttgtgcctgtgaggctccactcatttccctgaatcacaaaagctacagagtatttagatagaaatatacctactcttaacatgaaccattttaaatatatgtattactgtgtccacaggagtacactttaaagcagggacttcactcttcaatctctccaatcatgtgttacctaaagtggcatgtggttccctaaagcttaataactgacattgccttaaaaaaggggtttgcttcccaactaatgtggaaaaagtctgaaaaatgattttaaatctttcactaaatttctcatttggtcacgtggaggaaaatgatttcaccaaatagatactcttattaattttttaatgtaatttatcaaagaaatgaaatatttagataaattccaggtttcccccaccatgagcttctccgaaagtatactccatcacagactgctcactaagaagctctactgcagtcaaagtgaccgaatttaaggggacataatgactacttctgctacacagaaacattatccatctctaacacttccctatgagacggaagacggacttctaatcaggtaccagagagggctctgccaacttcagggctttgatgaataagaatggttgagagcgctcatcataaatgaattcagtataactgagtgagaaagtgagagaaccagagaaataaatcctcatgtagaaaatttaggggtgtgaaatgccaaatgccagttaaccaaagctttctttgtcataaagcaacttctataaaaattgctgaaaataaattcttcatggctcaatgtgaatcagtaatttccatttctattacactgttgtttacccaaaaactatttttaatgactaagactcagagtttgccaaagtgttttccacaaaacaactgttttgagatactccagatctgtaatcaagtaagtctgaaaaaccccaaatacctcactcacctcttggatatgcataaagcacactaatatataacgttctaaaaagccaatcattaaaactgttttatattgtttaagcatttcctagacatatttggctacaaatctaacatctaattaaacagtttgggaaatgccatcacataatgtaggaatattactagtcatttaagaaactagaaaatatttactatattctaggcagttggctagcagttggagttctagtctctaaacaaaatactgacttatttctgtgacttttttcttttaatgtgacatcactcttttaagcagctctgtgcttcacaattttttttttcctggtttgttttccacttttgtctgtactttattccttcacagatgtgaaaggctaacaaatgtaaactagttatattaatcagcctctgcctcagttctacacttcaaatacagtatatactctatcaacaattcttggataataacaacctgtacttgtttttcaaacaataaaacaggccgggcaccgtggctggctcacgcccataatcccaacactttgggaggccgaggcgggcggattacctgaggccaatatggtgaattctcctctcgactcaaaatacaaaataattagctggccgtggtggtgtgtgcctgtaattccagttacttgagagactgagaggagagaatcgcttgaacccggggggcagaggttgcagtgagccaagattgcaccactgcactccagcctgggcaacaagagcgaaaactccatcttaaaaataaaataaataataaaacaatgatgaaaacacaactaactacagcacttcagagttagttgacaaatccaccttttcaatctacatttcaaaatgttcagaaagacaccatcctaggggaagtcaaccagcagcaacctctctgctaatttttgtacacagaaacttgacctgactgcacaaagatttcaatagatgtctccctctaaaattaatattggatgatttgtcatcttccatttaataccaaaagggtatcagccacaaactgaaatatcactcatatgcaaataaataacattcaagacttttatcgttgtggttattaatcttgtaatggatggacataaatctatttacattctcatcctatcctcaaatttcactattctctcctctcattcttactttgttctactcatattctcactctatcctcctatgcataaaatattatgtattctaatgaacagagataccattcgtgggcaaggaaaaaacacaatgaactgctctttataataaaaaccatgatcttgacacagatgttatcaatcaataaactttacacagctttacactaaattaatacaaactgctgatgagtgggtggggggtggtcactaagcaaacagaagcatgtaggtgttaggaagcacgagaaacatatatcagtgggtagggaaggcagctctcaaaggccaagaatataagttttaggtctatatggaaaaagctgtggtcacattcgaaggcttctgaacagaagaatgattaatttcatgcttaaagagttcaggtgtaaataaactggatggataagaaactcaaaatcaagaattttaagacactgggttaaggtgattgagttaagtcaaagccaacagggcatgggctaaatattgacatgggatgggatgaagaggccaacaatgtttcaaagtagaggttgccagagcttcaggaaccagaagaggaagacttgaggtgaaatctgaaactgcaatccccatgcctggctcaaaagatgtgatactgactaggaaaaggctggagagagaagcttcttttaaagaggtaataagggattgttttgatgtgctgggttgaggtgaaaatgacaaatattcaggtggaagtgtccagcattcaagtaggataacttggaacagaaagcccaaattatgtcatggtgaaatgaggataatgtcttattaataaaaacacgtcttactagtctttcctggggaacatgaaagatagaatttcagaaatttagagaatgaaaaaggaaagattacaaggcaataagttgattaaaatactaaaataaactaatcagtggcagctatcttaaagcaagatatatcttctacagcacgatctacccaaatgcaaatctgggcagagaaatacaaaatatttttaggactgacaaaatttcagctatatgtctttttaaaaatgctgcagagagaaatttagatggattggacaaatatttgcataaggattccacagccaacgtacacaattttccaactactatggttagcactgggctcagacactacctttgccaaccagcagattttcagtactgcccctggcagacatcccattagcaatctctccccattcccaaacattcccaactattctagtcatgccaattcaaccaatgtcccttaagccttacataaacattgacttacaccgaaatgtatcctatggctcttactaactgtaacttacttaaatcactcaagcctctgttttccctgctataaaatgtaaaatagctgacaaaatacctatttgtattttttggaaacacgggataaagcaaggcaagcaaaaagaacagcagagacaatgcttaataaatatcctagtaggatcaccttaatccatgaagaaaatggagtttaatttttttaatacaaaaaaactcaatgaagttatacttacgttaaattggtggttattttaggtcagtggttttaaaactcaacaatgaaactgttttcaaaaagagttgttatacagaacagaaaaaagcagccacaattttaaaaaagatatgaagacccagattctgactaactcattcagctcccttcatactccctccccacagccacctcagctcctgaggcaggttcccagggctccaaggaacatacttttaaaaaatcagtattttgaatacataataagtgatgtaacttaaaagtatggtgagaaagtcccattgccaagagaaacatgttaattttttatttaaaaaatcatcactcttttcattgtgacatcttgaagaatgctgaatggcttcaaaataactgcatatgccaagatttctggagtgggcacgtttgatcttctttcataatgaaaactgacaaacctttttagggggatagtattgtttcttcactctcccccctcctcacccctgcacacacatacatttctccttcctggggaactccaaagaaaacaaaggccctttagcaatcaagtagattgtctctcttgatggcatcccatgagttatggaattacatactgcaggcccgggtggattagggcccctagaaagtttgcttgatcaacagagtgctgttgattttttcaactgaattaattactcttggagtccaaactctccagtgtgccacagtcctcatcacttcctgtatcttaaatattgcattatctgtcccctaaaagtatttgaacatgtgacccagagaagaggacttacaacttgactaggcaacttctgttacactggattcatatgaaattccactgcaagtgacatcaccagattggggaccctgaagtgtttgagtatcttctccacatctggtcatttaggctaagaaattccttcttgtctaccaggtcttttagcattcattgtgtaagtcattcaacacctacttactgagaaggaatactgggctagacagtgtgctagggcctggggaaaccgcaatgcataggagagaattcccatctccaagaggctcacagtcaaacagacataaataggtgattacaatatacactaacaacatagttttagaaacaactagcagaattatatagacgaagatgccaggaaaggcttctcagagaatctggcttggcaaatatctcaacaaagagggctgagcagggatgagccgaaggagaggatggaaagtaggttgtgggtgagttttccaggcagcatgtgcaaaggtccaggagaaagaggaaggagcctgtacttggaggaatattcgattactattatcagtgtcacacttgctattcatctagacagaagctcctgaaacaaaaaggatacacttcaaaagatgccaatatatccatgaccacacaaaagagtgtctagtcatataataaagggtgtacataggcaggcaactcacatcctgccaaatattaaatttctaattttattataatttctaataaaacattagatttattattatacagagtcatactcctcgattgggaaactctcaactcaataaacattctttagtctcatgtcttttctaaaggaaagaaattaatgttatattcttgggtgaaaaaaaatgtgaggtctcaaaagagtataatacaatttggggatgcatatatattttacatgtatatagacacataaaaatctaaaagaataaattttaatatgttaacagaagacagaagtcatgtattttttactttcttctttttggcatatctctttttctaacttttttttttctttttacaaaaaacaattgttatttgtgtacttttaaaacctcacagtaatattttcacactaccttcttggctgaaagttcacactcggaattccagagcagtccatggccaggcccactgggctccccttgctctctccttggctttggtaaccactggccccagggactcagcctgctttcctatccatcccctcagtagctgtcaccatgcaggttaccccttctgtttcttctaccactaactccatgtctgactgcaagtgaaaggaacagaagcccaaacctttgggttttaaggagtttattgctaatctgtaaaacagaaagagacaggagataagcatgacaaaatatagggaagaaatgacttttgcctaaacttccaaactgtgtacaattgaagcttctgctttatagctcttagcacacctctcaaataagaaggcagtactgggaaggctctgaacctgtggcagaaccaccgatagctgtggagctattccaaggagtctgggaatcaggggaattatcaagatcattgttagaataaattaatcttactgtatatatagcagaagttttcaagcatatgtaaatgctactaataaccaaataattacaccttgtttttctttaaactgtaactctcaagtatgtctctacataattttttgatggtagtgtctgcatgctcaaaaagcttgaaaacactactggagaagaaggtctcgggagtgtgatgaaatacgtttacatggcagcttcatcatttaattggtgaaagtgactatgtgtcttaaactctctgagcctcagtttgcacatccaaaagcaaggatataattccatgaacctttccacctcaagtccacaaggcagaatagcaagatgttaactgccactctgaggaccaccaaataaaaggacaatttattaggccacttgccagcatggacacaatcgactcttggcatttcttattatccacagaaaaattaaaagtataaatgtagaacaaaattatcgtgttttttttaatagtaacatgtaagatcaatctttgtctttaaaataccgtgtatctcattcttggaaagcgtcaaaatgaaaatggtatagtaagttttatctacaacttgaattaaaattattcttgaaatatgttctgaatggttagatgaaatggtaattaaatacaaatagagataatcatatactctctctccataaggctcccacctccttcaatgaagtctagttcacctaaaatgacactattaacattaattcaatattataagttgataagcacattaaatcaaaacacagcaagattattttaagagtctgactgaaatgtcaggatgagaaatagattaataaatattggcttctaatgtcggtaatgaaaacaaacacgttattttcagaaaataaaaggtcttcaccattaggtacaaatcataaagggattatctacggttactacactgtaacaactttttacatattgtattatagaacaagcttttgagaagacaaagcaacacatcagcagtttaaccaattgtctttctcttttaacaggctggtctacactagattacatataaaaggcccaggtattacttgtgttcgatcttagccaaatggctgagaaacatccaggtacatttaaatcagtgacaaaagaaaacattatcccttagtaaaattacataaaataggaaacatctcttactttaagagcaaccatggtacttgttcctatggtgaaaactgatgttatctcgattagttaattattcatcccaacacctggtcttgctcccttttccacctctagctatgttaacactagagttcagtaattagctgataaagaatcttaactgcagtatctaacagatcttagtgattaagcatatgacttaccctttgtacagataagtaaactgaggcccaaagaactgaggtatcttattaaaaatcagagagctagttagttgaaaagtccacctgtccttcctttccacatgtctcaccagaaaaacagcaatggtgaaaagtcaactctgtttttaatgggccactttgtatattttaactgttaaaataatccaagaggatagtagtcatatacgaagatcctttagatataatgtgtaggaccagcattaatttaatcaaccaagtctcctctcattgaattgttaattcataattacaaagatgacattacagtaaattaagaaatactgtaatttcattctctccaaaaagtatacattgaagtttggtgaatactgttatattttcaactagtaaatcaatgtgccaattctgggtcttaggcatattgtatatactggaatgatattcactttaattaaatttgttttgagaagtagaatgtaatacagatcctacgtgtttttaaaagttcacatcaatttcaagcttttaaaaatgtatgtacacaagaaagcttcttttgcaatttatatgtttacaaatgttgccattagctaagctatattttggaatgtgatcaaacaatattgaatgtcaagtcttaacagcagggctggtctaaggaattccctctaagctaaatctgatcctttcatatgtggctactgctcttttaaactactgtatccctaaagggctaaaaggaagaaaatcctaacttaataagtgaaggcagcaaggcatagtatttgaatggctacctttcattttaactctacttcttaaattcaaaattggatttgggttcgtttcaagttgttcacaatttactaacgaaatgtgcatctctcattcttcccccaaaagaaagaagtcatccactccagctacatataagtctccaatttctgtcttacaactaaacgtgaaaaccgaaataccactcattgaaaaaaaaatgtacagagaattggcaggctgcatgtttatgtgaaccttcagaaaacgtggaaacacgcagccccaactcaccaggaaaatcaacacttgtgatcaaactattttgtgacattttatgtcttttatacatttcacttcatatccagtattccagttttgcaccggcttgcctgtatcaaccccaaatcgcctgagagcaatctagtactgtagcagaaccgtttcaacatgaagagttctgctcatcgcctgtggcgtggtcttcgaaacacctgaatcaaacattgattcccctccccctgctatttaaaaccgagggacgtcaggcttgggttgtaggtaaagaaaagccacagtaatcaaacaagcaaccaaaatacccgaacacggaacacgctaagaacaaaggaaacacaagagtgtgaacaggaaatgaagcaactctacacccataaataccttctggggccgccaacataggtaaaagtaaaggtggagtctgagtatctgaaatctgaaacagaaagtcctgtcaaaagctacccctggagtggatttgttttaaccccgatcaggacttgggcgctccatttggtggagtcaggggaggcctggccgggcgggtggcgagggctagagggcggcgaggtctctccgcgcagcgtcccaggggatgcggcgcgcccccgactgggtgcagcggcaggccgcccccggcagcaagtgccgggtgccatggcaacggcgggaatttcccagtcggggcggccggaagcagccccagccgggctcgcggcagcgaaagcaaaatccgatctctctcccgggggagcaaaatggacgaaaggcgaccccccaggcaggggcgctgggtgccttgggaatccgaggaatcccttctctttgccagtcggaggggactagatggagccgaaggggccggagatgggccgagcgctgccccccgggggtcctcggcgccgggcgcagcttacgagcgcagcgcagcaggctccattcccggccgccgccgctcagcccattacgcaaacctggcgggtccaaccaaccccgctctgccgccgctgctggaacccaggaggcgtgcttgcaggcttcgggcactacgcggggctggaaataccacgcactgccccttcgcctagacccccgctcgggccacgcgggttctgccctcaaagctggtagctgccccagacttgggggtggggggaggggaaggggcgaggctggcgccccctcccgcttttggctcccgcgttcgttgcagcagctgttgccaaatgaaccccggaatgcggacgtgcaaaccctccaccccacccccagccacacacgtcgcggtcagagaactgggaagggggcgcggggtccgaggttctggaaaagcaagaactcacctgcaaacaggcagtcctcagctctggacttctggatcacgacgtcgatatccttctgaattcggtcttgccttgaacacatccccattaaataaatccttggaaaagaagcagccgctatttccaccccacccccctcgcacgctttcagctttcgtaaatattcagttaaaaatgaaacctctggccgaggcaggggctgaaggccaagtggtttcggaagtgatcctgggtgagaggaggaggaggaggaggaggaggaggaggaggaggtggaggagaagggggaggtcggctttccatttccagatgtgacctcccagctgctgctcgccgctgctggattccaatttcctccccttctggcgatggattggtgatgaaaccgagtctcactttctccttcccccgcccggaccaaccgccgtggggggccgagggtgccggggacggccggagagcgatcaccggctgggcggcgggagccgacgaggggcgagccccgctccggctcaagcgcgcacacccctcacggcccgcactccggccttccacacccgtgcacactctcgcccgcgggcggcggcagccgtgcccaggctgctgcagcgccacccgcccgccgcggaccctccgcgccctccgcctagtcacccggcccggccgcgggccgccggggctcgcagagtgtcagccatcccgggcaggagtcgcgtctccccaccccgacctccactcgcgccgggagctgagcggcagtgtaggtagtgaagactccctggggctcccagccttccctctccgcgctctccccccatcacttttatgaattcgactccactttctaaaggaattatgagtcttgtggcaaacacaaaccggagtggccgggagggggaaaaggggggaaaagaaaatctttaaaaattaaaaaaaataataaaacgaacaaatctttacttgttgccacctcagataacacggaaaaagccttgaaattactccagatgtgcaccctccccttccctcagtgcctgagtctttttcctccagatcgaagtatttcagcccttttggggcgccgtttgcgaaacacagccccttttgagggacttcctcctcttgaaaagactcaccagttctcccttcctaggtgtttctgttcatgagaaattgtcagaatcaactggcacgttccagggtcttcctaaaggatggaaacctgtttggcttgctttttaaaaccacctcctttgacagtcagtccagggaaagctacaatccaggtgttcagaaatgagatactgctctgattctcactttctgttctgcctaaggacacctcaggctgacgtagctgccccacctctatattggtttatgccctaggagaggtctccagcaggcacttttcttattgatcttttctccgctgagaaggctcccaccagtagaccatgactcgttttgctttgcattctcagtgccacgtacagtgcctggaatacaggagggtggcctaaatgttggctgaatgcatgaatggtcatttcttgcagcctcttttcattaccctgtctcatcagctttcttatcagaataagtgcccaagagtgccaaactgtttcagacccttaatcaatttagttctgattctgaccgtgacaacatgatgttcagcacggtaggaatgactgccatctctgaaggagtcttaagattctgtagaatcaatgaaagattctatgttctaacgcctttatctttcaggaaagaaattacaaaatagtttcattgtccagtcatattcactatgagttataagaggaaacattctatctagaactagaaataccatttgacccagccatcccattactgggtaggtacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcacttataggtgggaattgaacaatgagaacacatggacacaggaaggggaacatcacactctggagactgttgtgggttggggggaggggggaaggatatcactgggagatatacctaatgctagatgacgagttagtgggtgcagcgcaccagcatggcacatgtatacatatgtaactaacctgcacaatgtgcacatgtaccctaaaacttaaagtataataataataaattttaaaaagaacaaaacatcacattgtacgacataaaaaaaaaaaagttggattttgcaaggaagatagacatctgactaaagtttggccaagcaaggaatctttgttagtactacttcttgtttaaggaaagaagagacattcatctttccttcaaacagtataagtctcttttcttgtttgatcaccttttattcattaaggaccagttgaatcatctgttgggacttggtagcagaggatatttcctggatagtgtgagctatcaggcctttaatgtgggaagtttagtttctataaaaataaaattaaaaaagattaatagttggaacgaactataaagacagtttctgagcccagagggcagctgatcaataagatttctagatgctgggcttttaatatcttcagctggagtgagaagaggcattggattagtttgcagtttgaatgccataaagatgggccacacacaagctgttgtggtaatttttctgaagcttatgtcaagtcatccagtttcagtttgaaggacttcaagaaaagaaaagtttataattttagtgattccaagctagaatagcaggaaaaaaatgaaatattaatttggagtattgtagctaaatattgtagtaaactagaaaaattgaggatctattgcagattgcaggcagataataaaacctcagaaaaaaaaaaaaaaacagctagaatctaatattgggtgcactgcagttttctcccgaaacataacttttctctctatattcactctcatttctgtcaaagataatcaaagtcagattgatttgtttgctaaataagtttaatctcattaaacttgtactgtttatgtacacaagtgcagttaagagtagtgattgaccatttaggctcttttaaaggttgcgtttgtcagataagaaatctcagattaaactttttgtttttgtttttttagacagagtctccctctgtcactcaggctggagtgcagtggtgcgatcttggctcactgcaacctccgcctcctgggttcaagcgattcttctgctcagcttcccgagtagctgggattataggtgcgtgccactatgcctggctcattttttgtatttttagtagagacagggctttcaccatattggtcaggctggtcttgaactcctgaccttgtcatccacctgacttggcctcccaaagtgctgggattacaggcgtgagccactgtctccagtcagattaaacttttaaaagccacttgaggctgggatacaagcccaaaacttgtcattagtctgcacctgttacatttatagattcagataaatttctctcttattgaggtccctaaaatatcccaaggtttccacacctgccaaacagtgacattctttatttacctgtaagtctgggaaccctagagccagtttttccaagatggtactttattggttccataaagccaaccttagtcccctaaagccttctggtcatatctgaaaacatgatgtttcagtcaaagccttggtgatataacctgtgtttccagtttgtcctgttacaaagacaacagattcttattaaacttatgcaaataaatactttgccataaaaataagaatatgcacaaatagtttccaaattctggagggataagttagggagaaaaagtaaatgtttccattttgcacaaaagtattctttactgaattggtgtaagctagagatagcttaaaaaaaagttttctgaaatctggaaaacaaaacatttaaagaactagcaatgtttccaacaaaaagtcattttaaaaattattctcatcagttcattcagtaccacgtaattaaatcttgttttgcttgatcttgggttagtagttacatgaacccgtcagttttattagagttctggaaattcttaccagtccaattgtatgatgttaaagttgttcagaaacctgtattccagaatactcataagagtattttccataaatctccttgaagaagaagccattttggactgtagctaatttcaaatgcttttagagaacaagtaaattaaaacaatgactgtctacagatgacaaggacttaaaatgtccatggttaaaaaatctaatgagagttcattacaatgatgcaatttataagaaaatttggttagcatggcatacagcattttaacataataaccaaaattatgactgataacatactagatttctaggaatctcatacaacttttgtacacttatcccaataatatatccataaatataacttaaagatggcttagcatcactttttatttgaatgctacacatataatttagcatattaaataaatctaattggtttaatctctctttcatacaaaaagaaatattctttgtggctttctgagggtccaatatggagaatcctaagttaatttgaggtcaaaaagacttaacttagaatgtgattttgggaagattgtcaaaaatgtcaaaaagtttaaaacatttaaaacaaatattaccatagttatctatttaataaaagctccattaaaagattttaaaggcaaattcagattacatagttgtgaacaagaacttagctcctttaatattgagaagactcacttttcttaagtaaccaaaacctaataaaacaacatgaaactcaagaaattatcttgacgaaacagtctctgtttctgaggccaattacttaaaaggaaaaaaataccctttacattctcagaccaacattccaagaaaactttaccattttaacggagaagatcaaattctacttttgaatcaatgtattactaaaactaagttttaataaaaccttataaataaatctatccaatctcagtcagcttagaccatacaagataagattttcacaatccttctagatatgttttcttatttacatttgcaacagacatacaccagacaattaagcaatttacttttactacatatcctattcttaggttgaatttatggttttatggccttaaacatctaacagtaacaacacaaacttgtctaatcagcaaagccaggtaaaataagtgtatgctgacagttctgaaaatgtttctatttttattttaccaatattttttaaactagtttttatttactaaggaatatcccagattatgtgaacctaaaaaaaattgggtcagtttctacttttctgaaaattttatacattcttatttgtttgagtgctcatttatccctagccaatttgggtattttagtttggtaataacgttggaggtagaaaaatatcacatatacataacataataacatagatacacacatgtacacatacacaaacatatagactgatgtaaccagatcttatgacttttcatttaaaaaattttaaccaggccaggtgcagtggctcatgcccataatcccagcactttgggaggctgaggcgggtggatcacctgaggtcaggagttcgagaccagcctggccaacatggcataaccccgtctctactaaaaatacaaaaattagctgggcgtggggcatcgtggcgcccggctgaggcacaagaagcacttgaacccaggaggtggaggttgcagtgagccgagattgccccgctgcactccagcctgagcaatgaagtgagactctgtctcaaaaaaaaaaaaaaaaaagtttttaaccatgaggcagtaaaacagagtaatacaaaaatacaaactcactggtttatctccaccttatattgttatccaaattgtgtttctggtgagaaagggataagttgagttgacctacataacaaaggctaaatctttttaccaatatttgtggaggaggttttttaagattttttttttttttactttatcagtttccaaatagtttctttttttctcctattatcagccccaggtgcttgtttttgaggggcctctgagtcccttgagagccccctcaaaggagggtaggataggggtcctgaagttcagcagaaaagaaacgggtctggcaagagtggacagagaaatagtcagcagagacttgagaagaggggtttcaggtgacagagctcccatgggagaagcaggatccaatagagagaagagaaagagcagagtggttttatagagagccaggaagaacaatttgtagctcagggaatcagggaataacccctcactcagaaaaagagagccagaaagaagagacttctagtctagggactcagagaatagatcactcagaacaagaagcccacaggaagaccttcctgcccagaggattcctttcaaaagaagcctgggactctaccccagcttcagagagaatattcatcccttaagattcaaaatctgtccatagccatcaacgggcttttgtgtggagcaatggctcagaaatctgattcaccaatggatccctaatcagtcagaaatgacaacaaagacttcaaaggcatgcatttagggtcctgagtgagaggcccaggatccagtgatgaatctgtttcaacaccataattgttaaagaaaaaattattcagtgatacttcaaatgcacagtaaagaagactttattcaggaccattaccatagatataggaaccactgcaatacagtcttggagctggggagagagatgggcttaactctgaatacagcacggggaagtgggaatttatagaccaggagcaatgcaggggtcagtgaatggaaaatcactaagaggaaacatcaggagtaagggagattctggctaaaccgccctaaaagaattcttgctgaagactggccagggtgatcagacatcacctgcagaatggtgaagaatgaagaacctgatcagatattgagaatgagggggtctttggtaaacttggcagtgttctttgctaatgctggattttgtgaggaagtgcacagtttagcctagctgaagatttagaagcctgactaaagttggccaagcaaagaatctttgttatcaacatattccatcaaacctcacatccctgccttaaatgatcaaaccatccgcactcctgtatgctactgttctccatgaaaagttacttcttctttgtcttaaccaaaatccagccattctagaaagacaccagaaggctttctgcagcatctaaaatttccccacattctaggcccaaatccttttcctttccctgttgcttttagatccacattgtgtaaccctcatctagaaacctcagtttcttggagtcattttttttttttgggacggagtttccgctcttgttgcccaggctggagtgcagtggcacgatctcagttcactgcaacctccgtctcccaggttcaagcgattctcctgcctctgccccttgagtagctgggattacaggtgcctgccaccatgcctggctaattttttgtatttttagtagagacagggtttcatccttttggccaggctggtcccgaactcctgatctcagatgatccacctgcctcagcctcccaaagtgctgggattataggcatgagccactgagccaggccattctgtctttttatataatataacttgtacttttatgtagtaagttatcacaatggtgtcagacactctgaggaagagtattttactgtatcattcccattacccaatcaggaagtcttaacaggcagattttaacaaaaatataagacacaactgtgcctagcttttctcacatacttcctacctcacacttcacacatttctttttctcagcacccactcttaagtaataatttatttcccctgaatattatttaccttctgtgggctaccttacatatcatctgaaagcatgatcaaaacagttatatttgtgaataattttattttggtttatttcttagcagaaggaggagttaatagtaacatttgtaggccgggcacagtggctcaagcctgtaatcccaacactttgggaggccgaggcttgcggatcatgaggtcaggagatcgagaccatcctggataacacggtgaaactctgtctctactaaaatacaaaaaaattagccgggcatggtggcgggcacctgtagtcccagctactcgggaggctgaggcaagagaatggcgtgaacccaggaggtggagcttgcagtgagccgagatcgcgccactggactccagcctgggagacagagcgagactccatctcaaaaaaaaaaaaaaaaaaaagtaacatttgtaatctcccagagattgccaaggaaaacattctcctggctgaatttatgtagagttcatcatctaagcataaaatattttataaaggaatgggccaatcaaataactgctatgcggttgacactataaaccaagttagcttagtaccactctaaatagttgctgggaatataatgattttcaaagacatgatctctagaaataaataactaaaagagaagcacggtgtcatgcatttatgcatacacataagcagggactagagatcaagaatagaaataaaagaggtttttacacttggggtgctaaggtcgcaatgatttatttggagagaaaacagaagcccttctttagtaaatgcaaagcaccatgtgtttaatgaagatacatgacctaagctttgaagatcgtttaactaattcaataaccttaccaagtatccattactacatctcaacaatcaaatttacagtgacatctttgagttaaatatctccatagatgtctggaaacagcttaattctgttaactgctgcccattgaattatgcttaatttggttgtagaatttcatgtcatctgttattctccctcacaacttgggagacgttattcctgtattgtctgttctcgttgatgaagagaagtctgtgataaagtaattgtccttcctttgtaggtaatctgccttccatctctggttgatttgaaaatattgtattagtctttagtatcttgcattttactgtggtatgtctacatatggatttatacttactgagtttgctcagagcttggagtatttcctcagtcttaaaggccctagttgtgaaaatgttactacagaaaaactttatttttttaacttaaaatcctttttattgggaaataaatgtaagattatagataagtttgaaaataaaagaattgttagaacaaaaaatactcatatgcctgttaccctaatttgtctattattattttattaaatttaggttaccatttgttctctctctctctctctcaatatatatcccaattttcagtctttagttctaaatctttcagcaacctggactatcatggccccagtgtaatgcttggctttgtacctcatgagggaagaaattttttttttaatcttaagttctaggttacgtgtgcaccacatgcaggtttgttacataggtatacatgtgccatgttggtttgctgtacccatcaacttgtcatttacattaggtatttctcctaatgctatctgtcccccagccccccaccccctgacaagccccagtgtgtgatgttccccactctgtgtccatgcattctcattgttcaactcccatctgtgagtgagaacatgcagtgtttggttttctgtccttgagatagtttgctgagaatgatggtttccagcttcatccatgtccttgcaaaggaagtgaacttatccttttttatggcttcatagtattccatggcacatatgtgccacatttttttaatccagtctatcattgatggacatttgggttggttccaagtctttgctattgtgaatagcaccacaattaacatatgtgtgcatgtatacatctttatagtagcatgatttataatccttcgggtatataccctgtaatgggatcgctgggtcaaatggtatttctagttctagatccttgaggaatcaccacactgctttccacaatggttgaactaatttacgctcccaccagcagtgtaaaagcattcctatttctccacgtcctctccagtatctgttgtttcctgactttttaatgatcatcattctaactggcatgcgatggtatctcattgtggttttgatttgcatttctctgatgaccagcgatgatgagcattttttatgtgtctgttggctgcataaatgtcttcttttgagaagtgtctgttcatattatttgcccactttttgatggggttgtttttttcttgtaaatttgttgaagttctctgtagattctggatattagccctttgttagacgggtatattgcaaaacttttctcctattttttagattgcctgttcactctgatgagagtttcttttgctgtgcagaagctctttagtttaattagatcgcatttgtctattttagcttttgttgccattgcttttggtgttctagtcatgaagtctttgcccatgcctatgtcttgaatggtattgcctaggttttcttctagggttttttatggtgttaggtcttacatttaagtctttaatccatcttgagttgatttttgtatatggtgtaaggaagggatccagtttcagctttctacatatggctagccagttttcccagcaccatttattaaataggggatcctttgagggaagaaaattatttctaatattttaatccagctatgtatgtaaaaagaagtctttttcatattttatctgttatttctgtatgattggagtatgagtcaaaacatctcaatataaataaaaagttacatttcagtaatttttttttctaaaattacaaaacactagtggtcaaaaacactactatttccaattctctttcctttgttaacattactttttgtacttatgagagaagagtttgcaatccaaaaagagcaggaaggaagagagattagagattttttctcctgcttgctctatacatatgagatatttatatatctatatatcaacacttgacctttgaataacactggtttaaactgtgtgagtccacttataggtggattttttcagccaaatacagattgaaaatacagtatttgtgggaagtgaaacccacatatgtggagggccaacttttcatatgcgagctctgcaaggttgactgtaggacctgagtatgtgcagacttcggtatatgcagggctcctgaatccaataccccactaatactgagggatgactgtatatgtctctatctatctactctatcatatatatatatacacacacacacacacacaaatatgtgtgtatatatatatgtatgtgtgtatatatatatgtgtatatatatatacttcctatattactttgctagggttgttataacaattactgcagactggatgagttaaacaagagaaatttattttctcacagttctggaggctagaagtgtgaggtcaaggcatcagatgtgttaattttattctgaaatttctctccttgccttttagatagtcattttctcatcttgtcttctcatggacttttttctgtgcacatgtttgtctgtacctaaatttcctcttcaaataaggacaccagtgatattggattaggacccagacatgtgacctcattttacattagttacctcttaaaagtctctatctccaaatatagtcaccttctgatatactgggatggcagggggcagggtacagcatattaatttggggaaaggccacaattcagcctataacatatgcaatatattcttctctgatctatactatataacttttatatataatacatatataatttaatatacattttaaccccttgattaattttgtcactgcagagaaaacaagaattaaagaaaagcttcaggtgatactgtttttgaatgagtaagaattgagcctgcccttaacacaagaatgaagtagaaataaactgacttagggaacagcataaaaaagttctcttatgagtcaagatttcagtgtgatgtcatcattttttccagggattaaatattagaatatattgcatgcccatattgaggtggaatcataaacttatttcagacttattataatggctcattttcttatgccttcaccattgaacttgtacttagctggggattgagctgaaagtttgccttttctgtatctagcatagttgcaccaaatctgaccttaatcccaaattttcctttctgtaatatcttgtttccaaatgaggctcacattgaattttctcttgttagaaatataactggcaagaccaatcaaaaccattcattccattcagttgcctgtgaacaagcttgatttgctttgttattaatacagcttcttgtgggttaagtagaaagctcttttgtaaatatccctcagtttaagtatatatagtttacatttccaggtaaactgtaaattctctgagaaaggcccagcatggtggttcaagcctataatcccagctctttgggagtctgagatgggtggatcactggaggtcaggagtttgagaccagcctggccaatgtggtgaaaccccatctctaccaaaaatacaaaaattagccaggcatggtggtgcacgcctgtaatctcagctactcaggaggccaaggcaagtgattaaacccaggaggtggaggttgcagtgagctgagatcgcaccactgcactccaacctgggtgacaagctggactctgtctcaaaaaaaaaaaaaaaaattctgtgaaaagatctgtgatttccattctcctttatagtaattgttaagcactcacaattagatggttataacaactatcaaagaaaaacaattattttaataaatatttttcatcattttctcctttctaagccctatgctatgcactaaaaactgcagagaaaatcaacacattctctacctcacagcagatttcttggagagagataggggtggggaggggaataagggttgctaaatgttgtcaactttgtaatacaactctcaaagggagatagttattagggaggcaaagtgctcaggctcagatttcaggttgcctagatttgaattctgtcttcactgcttcttttatgatttgcccaaattacttaagctctttaaaccacagtttcctcatccttaagagagggataataaatagaacttatctcataaaattactgtgagaattataagtgattatgaagttgattaaatttccccagtgcttcatacaaagaaaggactcaaaggatatgctagttcatagtaggggcatagaagaagatatcccttctctcctgggatatagggtatacataactgtccactataaaattgaagataggctagagaaaagctaaaaatgaagaatctaataactctttagccaagagaaaatgaaacatgagggaaagggagaagttccaaatgaggtccacattagtcgtgggccactgaatggtggtgccattcaggcagaggaaacccagaaggaggagtcattctgtagttagagggcacttaatgagataatattagagataactgaggttgagttgttggtacgtatctgggtgcaaagtctccataggtccggaattttgaatagttttctggagtcatctggttattgttaaagccaagagaattggtgagatcacagaatacaataatgatcaataagagggaagggaagagagccaagaatgggagactgggaagcatacacatttaattaaggtttggtaaggtgaaaggtgtcagcagagaatgtaaaggtgaaataatgagagaaaaaggaggacatcaaggagaaagtcgtgttttgaaaaaaacaaaaaggacacattttcaagaaagacattgtcaatagtttaaatgtcacaaaatagtagagtataatgcatttaaaaaaaacaaaatctattgcttttgttaattaaataactagtaacctcggctgcagcagtttcagtagagtgaggagagttgacaccaaactgcaccagtggagtgaaaataagtgggaagaaagagtgaggaagtggaggacagtctttttttttttttttaataaaaatattttcccaaactgtcttttctggaacttccaacatgtctgcttaagagcttgtcttagttgaattcattcgaacttcttgaacctaattagtttctttttgctgtttttttttttttttttttttttttttttgagatggatccttgctctatcgcccaggctggagttcaatggtgcaatttcggctcactgcaacctcctcctcctgggttcaagcagttctcctgccgcagcccaattagttttaaagacgctgcatatattggcagggaaaacctagaacacaaagtcaaacttccaattatctcccttcagtgctcaaatcaagagttcatttgttgcaaggaatggggatctggactccagggagaagaatagagttttaggaggaaagttctcctaaaactaaatggaaggagggttctttgagataccaaggatttgcaggactttatttacaatgaaatgttagtttcagacagcccaggaggaataggtctattaaaggaaagcaagagtagttggcgtaaggaaacaatttgcactggagcctgagagtgagtatagtaatgaccacatgagagacccatttgactcaagtacttcaaagcattgccagtgttagtctttgctccataatcaagtggggaaaaagtgaaatgtctttgaagagcatttcctgtaggtggcctttgaggaggtcctgaaaattccaaacctgcaagtattaatggcaaagaataaaaatttgtttatataaaatacttttaaaaatctttctaaatagcaagacattatatattatcattgttaaaagataaacgaattgagaaatatcattagaattatatgcagcagataaaatggtcacttttttttttgagacagagtctcgctctgtcaccaggctggagcacagtggcgtgatcttggctcattacaacctccaactccctggttcaagtgattcttctgcctcagcctcccgagtagctgggattacaggcacgtgccaccaccccagccaatttttgtatttttagcagagacatggtttcactatgttgggcaggatggtcttgatctcctgaccttgtgatccacccgccttggcctcccaaagtgttgggattacaggcgtgagccactgcgtccagccaaaaggtcactttttaaacttaaaaattattaagaaaacagtgaaaacttaatgtttaaaagagtagaagatagggaaaattattacacagaaaaagataaacaacagagaaagataaattgccagtgaatatgtaaaaagttgctcagcaccagtggtagttcaaatccaaatagcactgagttagcatttgttaactaataaattggcaaaaattatattttgataaaacccagtgttgttgacatctcaagaaaaagggctatgctcacacagccttggagcatgtgcacattgatgattttgttggcataaaaattagtggtttctattaaaatcagcagtgtaattcacaatcgctaagacatggaatcaacctaggtgcccatcagctgtggattggataaagaaaatatggtacatatatgtcatggaatactttgcagccataaaaaagaataaaatcatgtcctttacagcaacatggatgcaactcgatgccgttatgctaagcgaattaacacaggaatagaaaaccaaataccacatattctcacttataagcaggagctaaacattgagtacacgtggacacaaagatgggaacaatagaaactggggactactcgagggtagaaggagggagggggtaaaggttgaaaaaaaattactatgcctagtacctgagtgatcagatcaatcatgcagcaaacctcagcattatacaacatacccatgtaacaaacttgcacatgtacccactgtatctaaaatcaaaagttgaaattataaaaaataaaaaagaaaatcaacaatgtgtatttctctcacacagccatcacgatgatgtatttggaataatatatgcataaggatgttcattgcagtgttgtctgcaagggcaaagtgaaaacaatctgaataaccatcaatatgacacagagtaagtaattattggtacgtctctacaatgcctcatgcagtcaccactgacagcatgggaaagagagacatctattatgaaaagaccactaagacatatgattacatgataagtgcaaggttcatgaataaatagtatgtatactagtatagcatacttctttctaagaaagaaaccataacacatacacgaatggacaagaaattattaacaatagctaactttggtgataagactgtaggttgtaaaaagccagactttcatttctcattttaaacccaatgaattatttaaatctaaccctactgcattcattatctttataataaaataaatatgtataacaatgaaacatactttttaagtatttgggacataaattaaacattaatagattacacctcttaaacttggtactttagtatcccatttctctgtgagaactctgaaagcttcatcttccacagtttaggtaattctttggtgtcttattttgttattttcttgccctgagattagcaatgtcagatctccaaactactaactcttctctttggcagatcaaatgcttcttcttaaaaaaattgattttttaaaatgtatttcataggatttttgttctctctctccctctttttgtgcatatgtgtgtgtgtctgattagtctttattatcttaaaatggttagtcctgatagacctgtttcttcaaaatttctctcagttctttggcagtttgctcttagcttataattaaagatcaatttctgacttgtcttgttctagaaaacctcaatggaaattacagcaagctgaataggatattaattaaaaacataaacctggtgaaacccgaacatagaggctctagttcaaagatgcttccaatagttgacatggccattcattccttaaaaccagctatttttctttcgaattactttacctttaattctgtaaattggatgttatatagtaccatgaaaactgctgtgagtaattataatactcattgctgagtgatgtgacttctttctcaaggctatttctgagggaaattgtacaattagatctttaggtattgtgacttgttttggaaatcatggtggccctccagggagctaaagaatctttaattatttagaggttcacatgagaccccttacagatataagcacattagctctgtagctaagggaacatttaaaaacagtaacatgaaatgtgtcagacatagaggaaagatgaagaagcaagtagaagctaatgcaaacagaggaactgccagctctctgtggcactctagctctctctgtcagtatttggttggcaatgtagacatagtggatgagtgcaattacatatgttaggctcattctgaaatgcaggagcattttagattttcatgtagaagcctgacaagcaaactacatctaggatatactttgataactttgagttgagagccaaattttttgaaggtaaaccatctccctgttttaaagtagtgtttaaaattataaaaatattaatacatctgtaacataaaatatttagatataaatactacaagtgcaaatgaatttttttttctacttctgcattcaacttttctcttctccctttagggaaaacacttttgtgtaaaggcctccaaaatatatgtagagtcgtatgtatgttaaaaacatgtatacatataatgcataaccaaacaaatgaaatatcctaaacatatggacctgaaaattgcttataataaatttgaactgaacatataggcataaatgtggttcagaagtgtccagttgaagcaacttcactttgttaggtcaacaaaagttggggacaccaagatctactcctctgattttgttctagcattatcttaatggaaatgtttactgaaatggaaatacatgtagtggacatcgtggtggtgtctcaagcattcagtgttccctgctctcacacactcctagccaaataatgaatttctcagcttcacaatgtttaagtgacatgagtcccatgcccaattcttggtcattgtaattggtgcatgaaggaacatgtgccttctgctaatcaaatcagaatgaagtacaactttttcattccatgattgaagagggaaatgccttctttccaaatgcagcagaggaagcacgaggtactaggattggaagttgtctactcatgacatgatattttaagccatagaataaaactgagacctaatgtcttagtcctttcaggtcgctataccagaatatcacagcctggatggtttatgaacaacataaatttatttcttacagttctagaggccaggaagtccaagatcaaggtgtcaacagattcagggtctaatgaggatttgtttcctggttcacagacagctgtctttttgctgtgccctcacatggtggaaggggctaggaagttctctaaggtctcttttataagggcactaatcccattcatgagggctctgtcctcatgacctaatcaccccctgaagacccactgccaaatatcatcacactagggattagatttaaacatacaaattttggggggatacaaacattcaatctatatcacttaaggtagagtgaagaaacagggaggacaagaagcatttattttgtgtcattattaaacttctgcattaaactatcttgagcctatactattgttcaaaatctctttattatacaagccattttgaattttgattgtttgcaaccaaaattaacctaataaattaaaatgtactataatgttacatcataatttgtctgtactagtagtatttgctagaacgtttaggggaatacttgcttgttaactttttagtaaatataacactccatgttcaaatacatttggaaaatactgagcatttcacacttttagagactcaaaacaggcagcacatttttaaaaaataaaaataaaaccaaatagcattgcatttggagaatggtataaaaaaagagaatttgataaactggagttatcagaactcagtggatactatgtgttagacattattataagccattaaacattttacaagcttgatatctgagttaaaaattaataacccaaagacacattggaagagaaaagttgacatatttttattatattaatgacctaaaaatatcatagcaactaacatcattatagtcaacaagtgaatgaacgtaaataatattaaataactattagaaagtctctctgattaagcatggaaataaataggcagtgcttttgaccaataaatggaggagttacaatactttccaatacaaaacaaaaagattctaaatgtaaaggtattaggcccaaaatatgttagtcaattcatgacagcagaaattcagcaggtcatatttttgaggtaatgtaaatgacaatagaaatcatggactaaagtgtaacaaataagtaatatctaggcaggtggaaattttaagatcttttaaattaacttctggactatagcaaaaattcaaactaaaattcatcagggagtcagggaaggtcaaatgaagaagcatggggactgaggcaaaaaccctgaattataccaatattatcttttttttttttgagacaggatcttgctctgttacccaggctggagtgcagtggtgcaatcatagttcactgcaaccgcgacctcctaggctcaagggatcctcccacctcagcctcttgagtatctgggactacagaacctcatcaccaaaacacccatctaatttatttattttttgtaaagatgaggtctcactttgttgctcaggctgacaagtattatcttaatgttatagaaaaaaagtaattctggccatatataggtattattctttgcagtggaatatcatttcagaaacttgtgccaaacataaaattagttttctagtagtaaaaagtaattaaactctttaaattattattacccctagtatactggggaatgggtgtgtgttccaaatgaaaaaacttgggatgtctaatgagatgctgttttctgtcgtagaaaatctatgtaaaatgttttttctcacgtgtacactgttgatatttgagacagcacatgttaacacttcaagaagtaaaataaatgtgttgattatatccacagttttcatatttattaactacatatttcgtttttaatgtaatgcctattgaaaaacctgtaaatagttgtttcttaaaattgacaaatactgcctaagatttttctgtatattttcatatttcaattttcctgtgaggttagaatgaacattttagctaagacatttgtgcctccaaatcctaaacctttcagaatgttagtttattatttggtttttacctaaattattttctgcttattcaagaaccttaggtctatccagttacgtttttatttttttatttttatttttttattttgaaacaaagtctcgctctgttgccaaagctggagtgcattggcatgatctgggctcactacaacctctgcctcccaggttcaagtgattctcctgcctcaacctcccgagtagctgggattacaggggcataccaccacacccagctaatttttgcatttttagtagagatggggtttcaccatgctggccaggctggtctcaaactcctgacttcaggtgatctgcccacctcaggatcccaaagtgctgggattataggcatgagccaccatacctggctgtatccagttacatttttaagaccagccaggcttaatatatatttggtcttttgctcaattcaatttgttgcattttgtccattgtacttcatgtgacacagaatatatcttaatttaaaaagacatatgtttgttgagctatctgttacgttggtatatcttggaattttaaaaaatataaaccacagaagccaattatggctgacattaacaataaataggtttatcacagaaatagtggggaacttgtagaactgttgagaaggctagaaagccagatcaaagctaggcagccaggaaatgtaccccaaaccatgctgtagaactcatccagggaggaaaccactgtcaccaccagtaagaaataacaccgaagatgcagggagcaacaattgcagcaattgctcaatcctaggctaactgcaaagccaccagcaccactcccacttgttcgctttgcaacagatattgtagcagctgctacatggcctccaccagaaacaagagaaagcataactgaatctgcttctttttttattaattccgaagtggaaattcagcactggcaaacagattggcaaaacctaagtcatatgcttgtaccctagctgcaaaggaggctgagaaagcaagcatttggcattttagcttctaaagcaggaggtggtttcttgttttcgtcaaaactgagaggctgaggaattcctcaaacacagcaacaaacatcaaataataaatattcatgctttaacttgctcaatatcaatataaactttcccttttgaaagtaaacacgaaagacccaagcttccttctaacagagtgcaactatttctctaataattgaacatgtacctacaatctcttgaacaatgaaacaataaaaaattctcaatcacagcatgtactctaagtctaagaattctgggttatgtccattcctctacgaagttcttcactatactctcttgacattctgccatatatcatttaaaaattaagttaatcaccctcaataagccctgttttaaaaagagggataaatggagaggaaagaaggaaagttgttaagatacataagtatgcacaggacaatacaagagaaacaatgtgtttggatgtcaaggctctcctttctgcaagtggccagcaggtcactattggcatctatggccatgtgccctcagctaacacctctgctagtcagggttttgccttgtgagatgaccaaatattcattcctgacagagaaatgtccttgataatctttttgtgtgagcgtgccatggtcattgttaatttctttcatttaacaaaataatagactttattttttgagcagttttagctttatggaaagatcgagcagaaagtacagagttctcacatactgtcacctttatcccacccccagtttacattagggttcactctttgtgtggtacaggtctaggagttttgcaaaacgcataatgtcatgtacccatcattacattattaccaacgtattttcaatcccctaaaaaatcgcctgtttcagaactatttatctccctacccatccccaaactcctggcaaccactgagcttttttgttgttgttgttgttacttagtttttatttcataatcataaacttaactcaactctgcaatccagctaggcatggaagggaacaaggaaaacatggaacccaaagggaactgcagcaagagcacaaagattctaggatattgcaagcaaatgtggtggaggggtgctctcctgagctacagaaggaatgggtctggtggtgaaaataaaacacaagtcaaactcattagaattgtccacagtcagcaatggtgatcttcttgctggtcttgctattcctgtacccaaagtgctccatggcttccacaatattcacacgttctttcaccttgccaaaggccacatgcttgccatccaaccactcagtcttggcagcacagatgaaaaactgggaaccatttgtgttgggtccagcatttgccatggacaagatgccagaacctgtatgctttcggatgaggttctcatcatcaaatttctccccatagatggacttgtcaccagtgccattatggcgtgtgaagtcaccaccctgacacataaaccctggaataattctgtgaaagcaggaacccttataacgaaatcctttctctccagtgctcagagcacgaaagttttccgctgtctttagaatcttgtctgcaaacagtttgatggagatgcggcccaagggcttgccgtcgacggtgatgtcaaaaaagacgacggagttgaccatggctgatagtacagggctcacagtgatggtggcatctgcaaagataaccactgatctttttactgtctttatagtttggccttttccagaatgtcgtatagttgaaatcacagtatgtacccttttcagactggcttctttcacttagcaaaatgtctttgttttttctgtatctttttgtggcttgatagttttttccttttagcactgaataatattccactgtaggaatataccacagtttgcttatgtagtcacctattgaaggatatcttggttgcttccaagttgtggcagtcttcattaatttctttctttctttctttctttcttcttctttttttttttttttttttttttttgagacagactcttgctctgtcacccaggctggagtgaagtggcacaatctcagctcattgcaacctccgcctcccaggttcaagtgattctcttcctcagcctctggagtagctgggattacaggtgtgcaccaccacgcctggttagtcttcaggaatatttacaggactgtatagaattaggagccatcaaaggggatccctgaattctttctgtttttcttacaaataccagttttaaggtcaagatttactaccccatgcaacaatgtagccgcattttaaattttaaatttttgacagtttgtttaaaggtctcaggcaacctaaaaggctagatagaagtctctcatcctctaacgaaggatggattgtaaaatggaatactgctaagactctccctttgggtactaattctgcaaaaacctagaatctcagagacaagagacaagtatttggagtggatcattagatgtaatgacaaaaggagtcacttcaacgttcataacaaatatcaaagattgttgtattttttatatgggagacaccagacaagcttatacttagttactagttcagaggatacaccaccacatcgtctagcatgagtacaaccttataagccattgtctccagctggcactgtgattgagtctttaataaaatattcaccattctataataataataattttggttggtgataggataaatggtggaccaggtgagtccaatgaatatctactcatttgttatacaacaagttcttttaatagaaggatgtagaacaggatattatggcagtatatataaggcattcaatgtacccatggagagtggcgatcagagaaaaatgatgtcaggtaaagcaaatgtaattcaaggataaaggtagattccatttacaaaattccttgttgcctttatcatagaggagctccagtaaaatcaacaagtctgacaaaaggtgactggtttattcacccaggatatgttattgtgtgcttagccttggactttgttgcttgtgtgttggacgcctaatagtcttgacagctaaataggcttttgtaagcgagagtggtaaagtccaacatgttgctaaacctatgtgtattctctactgctaccaccaatgttgctgtttattagccttctgagcaagcaatgtagtgcctggtgaaagagattgtttcataccttcatatctatttgataaccttcctgatgatagtttggtgagcatttgtattaagcacaaatattcttacactctggctcattttctgtggttcatctacatattttttccccaaaactcattgccaccaatccttcagtgtttgtctttctgagtccctaattatcttttcttttcttttcttttttttttttttttttgagacagagtttcgctttgttgcccaggctggagtgcagtggtgcaatcttggttcactgcaacttcttcctcctggattcaagagattctcctgcctcagcctcccaagtagctaggattgcaggcacacaccaccacatctggctaatttttgtatttttagtagagacggagtttcaccatgtcagccaggctggtttcgaactcctgacctcagacaatccacctgtcctgtcctccaaaagttctgggattacaggtgtgaaccatcaggcctggccccaagtccctaattatctagacaaattattagctgccacatatacatcaataatatctctccttctagacatcgtggacaaccaattacataggctgaatttcttttaaaattgcattcacgtaggttataatgcctaagcaatctacttttggctgttgctgtgatgttgtacagtgacttctgtaaatcaggctcaatttttccctcactaatcaactggccatagagaacttcccatgaagacataggtatagattctattattcctacctgctgatgaagcaggatagttaattggaaaacacttatttcatgataagcagctcatgttgtcatatttttttgcattgataggacttcagtttctacaatggtccaggatcaatcaagagttctttaaagaaaacatttattttgtcaaagaaagaagcattttgttccaaatcctaagaacaatagtagtggtgtgtcagaggctctattgcatctggatataaaaacaaaggggcacaatattcctgaccagttgggaattattatcttgatctcaatcccatcaaaaggtggcagcatgacaagtcatgaagtaaaaggaccaggtgataaaatgaggtctccaaaatccaaagcatcaaagttctcagttagtggtcagggctgcaaagtgccataatttttcactttggaaggtatatcttgagaatattgagtgtatgagacaagttaaaaggtcatgcagccagacgcggtggctcaagcctgtaatcccagcacttagggaagctgaggtaggcggatcatgaggtcaggagttcaagaccagcctggccaatatggtgaaaccgcatctctactaaaaatacaaaaattagtggggcatcgtggtgccctcctgcagtcccagctacttgggaggctgaggcagcagaatcgcttgaaccctgaaggcgaaggttgcagtgagctgagttggcgccactgcatccagccttggcaacaccgcgagactctgtctcttaaaaaaaataaaaaaataaaaataaaaaaatttaaaagttcgtgattaacacctctgttagcctctgatctttataataattatcacacacacacaaaccaaacaccacacatagaggaaacagtaaaagattaaaggacacagctaaaaatacatttgtattattacttcccaaagttctaaaattatgagaagggactagtgaatctttaaaaaatattgattatccaacactttttaataaccagtataattgcattgaaggctactgaacatgcacatgttcctaaaatttttctgttatggtgtctggtttgcgaaaggaacaaaattaaacatagttccttggcaatttttccctcttccactctactaattggcgtatgtgcgatgtgtgtttattgtaaaataggaataagattcagaggtcaagaatcaaagtgagtcagagtaggaaaagccagactcaagcataacagaagggcagagcctgtcaaaccccaaaattaaagggtaaatttcaacacaagtagaagtggttcaaaagctaagggcatcctcatagttcatgaaaagcaagtattcacgcaggtagcagactctaatctgcttcaagccaatgtgctattctcttcgtgttatttatatccctcagaatacctcaaagttcccaagagcagtcagtatttaactctaaactatatcatctatatgatatatttattatatataatatatatattatatgtattatatattatatatttattatatgtataatatatattatatatttattatatatataatatatattatatatttattatatattatatttatatttattatatatataatatatatctgtttattattatattttttttgagacggagttttgcttttgttgcccaggctggagtgcaatggtgctatctcggctcaccacaacctctgcctcccaggttcaagtgattctcctgcctcagcgtcctgagtagctgggattacaggcatgtgccaccacgcctggttaattttgtatttttaatagagaaggggtttctccatgttagtcagtctggtattgaactcccatcctcaggtgatctgcctgcctcgacctcccaaagtgctgggattataggtgtgagccaacgtgcccagccaactatgtaatattttaattgtgtagtgataaccctcatcaaaaggagtattcattatggtcagtgtactctgcttatttaccactaaagcttaagacaaaattgttgaaataaacatgcatattgaagtacttagctagctattgaggcaatacaggtttctagatttactcatgtttttcactgtacacacatgtcatgtgtgtcatgataaacccatgtgtgtgcatatattgattaaatattatatttctttttacttttattattattattgagaaaaggtctcactctgtcgcccaggctggagtgcagtggcacaatctcggctgcctgcagccttgtcctcccaaagccctagaccctgtaacataatagaatatgtatgtttctaatttgtgcaatatggaagcaggaatactacatagaactgtcatcttttcctattgcatttattttggtgtggaaaaatataataattggcttcagtcagtaagtctatttcattcaagaatatttaaatataatccaaaccatcttagatacattttgtgatacaagaggatggtatcttctacttggaaatataaaatcccagggtctcacagtttaagtatactttccaggggtatgtataaaacaagaatcccactttacaaagttaatagaaaaaaaaatatgctaattggaaggagaggcttctgattgaggataaagtggaaattttcacatactgctaattacactttaatggagtaagaaaaaaagaattggaaatagtaccttataaaacttctgaaatgaattacagtttctctctctctctttcttttttttttttcttgagatggagttttgctcttgttgcccaggcgagagtgcaatggcgctatctcagcacactgcaaccttcacctcccgggtttaagtgattcttttgcctcagcctcccaagtagctgggattacaggcatgcaccaccatgcccgctaattttttgtatgtttagtgacccaccacgcctggctgtctcctctttttagaattaggagaactgatttttttcaatgctaaactggcactgtcctgtgttttcaagaaagcaatatggtgaaatggaagagtctggatagcatgttttgttagctggcgtctagttctttaagttccatgagtctattgtgtcttctttacatctcaaaaagaagagagaagaaacctgcatctaattactgaagcagtttcattcagcaaatgtaattgcatcgcaggcacatctcaaattaaaaatcttgatcttggtctctgtcatttccattttaaactgggactgaataacctgttttgccactcaaaataatagccagtgtctctttcttattaaaatatgtgatcttttgcttgattacctaattatgtcacctgcaccttacgtgaggcagatagaagagtcttccagtctgccagagcagatctaccaaactagactgcacatacaaattacctggggatcctgataaattacagattctgagtctgctttcaaacagggcctcaagtcaagctgatggtattagtcccaggatccctcactgagtagcaaggtcttagaattaaaaagtgtgcaagtataaggccaggagcagtggctcatgcctgtaagcccagcactttgggaggccaaggcgggtggatcacctgaggtcaggagttcgagaccagcctggccaacatggtgaaaccccgtctctactaaaaatacaaaaaattagccaggtgtggtggcacgcacctgtaatcccagctactcagaaggctgaggcagaagaattgcttgaacctgggaggtggaggtagcagtgagccaagatcatgccactacactccagcctgggctccagcctgggcaacaacagcaaaactccataaaaaaaaaagtgcaagtttataaacatggaaacgtggacaattgtaagcaatattagagaactgtagaaaacaattttttaagtgatatgtttaacctatttagaataaaacccattagggtcctaggaatttctggaactgccttacttgtgagaaacatgatcctaagatgcccatttgtttatcagtacatcaattttctccttcttaaattggtataattattttcttccaagaagcctagcacacttttgttgttgtcattgaaagagggcatataagggttatggctgctatttggagaaatgcattagaaaataaaaagcttgaaaaagttgtattactgagaaaaatgttgaatgaaaataagaaagattaaattgaaataaataatgaatcagtaaggtatgcactgttaaacacttgatgggatttcccaagtattgacatgctgataacttgaaataagaatgggagaaaaggtcaatctgaattcttaaaatgttgaaggctgggaataagaagtaatatatcacagaatctgatagaaaaatttttatttattttatgggagaaaatgggagactaacagacaataggaataggaaagaattaatagaaatagcaaaaagaagtgtatctgcaattattaatataatacaagaggaaattgtgtagagatatttaaagaaagattgatgaaatttagatttatggagaaatatcctaataaagacattatttacaatcaactgttcataattattatataattctgacagtttttaggatataaatgtaaggcagaatgatctaatataaaatgtataaatgggacaacatataattttgcttaggaaattgaataaataaagtagtgatttacgatttgcattaatataaaaaaatttaaaatggtttacatcttgtttgaaatggatgataaacaggaaaaaagtaatttagtacattgagtaatttagtacattggtcaccaaagaaatacaaattgaaactataagatgccttctcccatctttgtcagatttgtaggtataaaaacagtagtagttgtattggttggagaacagaaagatgacactttcatatgcggctgattagagcacagattggtatattatttctgagatgcaatttgaaaatatgtaccatcagcctcaaagatgattatgaccatgtgtcactactttcttggaaatcattattaatgcatgtatagattgatgtttactgtagtattacttaacataatgagttgagtacaaccttcactcccaaaaaacatgaggtaggggtgaattagttaaatatacaatcacaatgagctatgacaaaatgcagttacttaaaagcacatttataagactattaatggcaataaacatgatttgatataatgttttcaaaaattaggggaattctattcctagcattgtgacagactaaatttgctgaatcactatcctgctatatgaaatctacaaataccagataaaatgtacatgtcatttttcaaaagtatattactgacttgaatagaaattaaggtgaaccacataggccaagcataaggagaatacataaatccagagaggtatgcagacccccaaaccagaagcttccataaggacagtcctggccctagtaccctgagcttcaatttttatgaccacctgggatatgggagagtgtgagacaaaacctagtgcctgcccagtatagcagtcttacaggagaaaactgctgaaagccagagatacgaaggactataatttcagtgaaaggataaactagataaaaacctgttcctcagggggagacaaccaggaaattttcctgcctcaaactcggtgctatttagaggaaaaattagaaggccatcttcacatgaatttgtggtttaaattttcactgtaagtataattttaaaaaaacccacacatgaaactgataatttattttatagttatcccatgttggtattaccaccaaacacaagacgaaggcaaagtgtctttggagaaacccacattcagcccatgtctcaaagaatggccacaggtaaaatttcatccaaaatgagaaaaaagtaagactcttacaaaactcatgaggaaataaacatcatgagcagaaacagaattatgcccataaagatttcagatattaggatgattatataactataaaagctgtgtttaataggtttaaaaaatcaatgaggtgtgccaggaatataaattgagacagtgtatgtatcttatgttaagcagattgaaactgaacttaagagatcttttagaaataaaaaatataatgaaaattaaaaactaaatggacaggttaaacacaatattggatagaaccaaaaagaaaataagtgagttggaagttagactaaacaaattatgctgaagacagtacagaggaggaaaggaaaatggataggtgaaatagaggttgaaaaattagagtatctaatcatatctgcaaaagaaaaattgaattgggggaaggttatatttaaggttatatttaatatctgagggcttttcatcattggaatttattaatgttcaaggaaacctggaaagttttctaacacattaaaggagctttaattataagttccaaattcttcttagaagaagagaaccagcaggcccagacatttttactggtgagttctatcaaatgttttcaagaaatggattatttccattttataaaaacaactccagaataaaaaaaggtccatttgttcgttcattttatgaggccagtacaaccttgataccaatgttatatgagaaatgtgtaagacaggaaaattacatgccaactttcctcatgaacctaacggcaaacattttaaattaaaagttagcaaattaagtttagaaatctgtaaaaaagataatatagtatgaaaattgtgtttgttccatgaatgcaaggatttctaacaatagaaaaaaaactatgtataattcatcacattaacaagttaaaggaggaaaagcaaatcatcattgtagaagaggcaaaaagtgaattcaataaaataaaatatttaactttgacaaatcttgtttagcaaacaagaaatagaagagctttcagtgtttgcttataaatcagaaactattcttcgtctttcaagcagaggtgatttaatacaggtgattgattacacaagtgatggaagccaaaccaggcttggtgagtcagcagctcaagagcaagaaaccagtactgcccctaagactagaaggatcatggaagaaggtgttattatcagagccaaggggccaggacttcaggcaggttgctagagctaatgggaattgggtccatggagggaggggctatctggtgggaagcagccctgcagagaagaggcaggcttttatggcatctctcactggatagcctactgggaaaatggagggcaaaggagactgggaaataaatgttattttcctgaaacatagaacagagttggagagtaatttgggagggatctgggggcaaatttgtcaggacccaagacatgattaaagcaggcagggaaaagagatgctggtcaaagcaggtggcctttgctggtatttcaaagtcctagttttaaaactcagaggttttaaattattatcttattactaatcagatattttatacatatttaatatatttatatattaaatatttaattataattcaaaacttttatgtacactataatctcattattgttttctatactattatatacaatatacaaatacagaaatacagaaatgtacctcagtttgaaagagaatttgaatatgaggcaaaaagatacccccaaattatagttacattacaagaattgaatttaagaaggaagaagcaaattgcaagagataagaccaagcctctttagtaatgatcattctaaatccaattggtataaatttagagatgcacaactggattgcagtgtaactaagaaagtttgtgtgtcaaaaaccatagttatcctatgtgaagaaataatagtttcataggagaaggttaattggcatggagtctgtaaaagagaagtttggatagatgatcgagctatatatttgtcaaataatatctaaaggtaaaaagatctagttcacagaggcgaatctctgattttttaatttgcattaacagaaacaacattggaagggagtatattaagattttaatagtgactatttctgccaatggtttctgttttattgtttactattttcggtatatttccaatgtttcttaataagtgtttattatttaaaaaatgagaaaacagcaatgagtaattcagtaaaataaaatttttcaaaattgtgactgctatgattatgagccaattatgaaagaaagagacacagatagaaatagggtgaccaatctttcaacttactcaggaatgaaggattttctggatgggggatttttgttgctaaaatcgggacagtaggggacatattgggactgtggaaaaaccctacagggatttatttcctaactatgaatgtctatcttggtctagagacgactgttctcataaataggtagagtagatgtggtatttctggaatgagatttaacatctttacgtagcttgccctattaaaagtagacaaatgcttgtgagagaatatcatatacttttgaaagctaatgtcttaactaatttgctgcaagcaaagctcttgaagactctgatgtaacagagattcctaggtatcagtgaagatacggagatgaaaaagggaagttgaaaaaagaagctgagagataagcatggaaatcattttccaacctcatttttccagtctccattttcctgtattgagaagtgaaaatatgttttctagagataaagttctagaaatgaactctgacatagatattttaaaaccaatttcagaaacaaaataatatgtgaacctagagtagttgtaatttatgtccttttgtttgtctttatcctgtagttaagtttcccttgggatctctttgggaaaatggagtactgcattttacaaggcaggacttgaattttctttcttttccttctttctctctttcttcctttctttctttccttttcttctttcttctttctctctttttctttctttcttcctttccttccttcctttttcttttctttctttctctctttctttcttcctctctctctttttctcttctttctttctttctttctttctttgttcctttctttctttcttctttctttcttcttttccttccttccttccttccttcctcttcttcctttctttctcctttctttttattttttttgacatgatctcactttgtcacccaggctagagtgcagtgatgtgatcatagcttaatgcagcctctctctcctgggctcaagcaatcctcccacctcagcttccagagtacctggggctacagctgtgtgccaccacgcccagctaaaggacttgaattttcttacatatcttggccctatagagtggttctcaaccttggctgcacatgtctattacctgagaaaagttttaaataacctaatactcaggtcacaccctagactttaggggtgagacaagcattaatattttttaacactcttagaattaagagccactaatattgtagcactgcaattcctataaagagaacagatgtgagtcgatttgttacagtattgttgtattcatctgttttcatgctgctgataaggacatacctgagaccgggcaatttacaaaagaaagaggtttaatggacttacagttccacatgggtggggaggcctcacaatcatggtggaggacaaagaggagcaagtcacatcttacatggatagcagcaggcaaagagacagcttgtgcagggaaactcccattttaaaaatgatcagatctcatgagacttactcactaacacaagaacagcacaggaaagacccatcctcatgattcagttatctcccactgggcacctcccacaacatgtgggaattatgggagctacaagatgagattgggtgtggacacagccaaaccatatcaattgtcatcactcaaggcagatgagtatatagaaagctatcagttgtaaggaattggactaagtttaagagaataataattaagatagaacaaatgtttggtcctgcttaagggctaggatagatgaggcacaatagaatcatgtggggagctgtaaaaatgcccaggccctactctgtgtcaattaaatcagaatccagaatctctgcttgagtgtgtctagagtattggtcaaaggaaacagtgattttgatgtgcagccagttaagagctgatatcctcaaggatcatgatgtgacacagctgtttcagaagggtaaatctccatactcccactttagaagaaaagaaaaggcaaaatgacaaaacaatcaagcaaaagggctggaagagctggtagataacagggtgtcaacttgaattaattcagctctttggtaaagattagctggagtaaagaaattccagttagtcaaatgggatgaatgtccttttatggaaaccatatcatgctttttgaatgatctgagaaagactggaagcattagaggtgaagtatatccatttgctcaatgggagaagattttgttttattttatttacataatgtgatatgcttggccatctgcagtagtgcctgaaaggggatgtaaaacggaaaatgtagtcaatgagactgattaataaccctgggtagaaaaataggccaagtggaaaaacttattcatataattgcttcattttgctgactgcaaaaggatttgttttggaagtgatttctgctctttaacctagtggattgatagatcacagaaaggtcttagaaatgacattacgtaattttgttcataacatgaaattagcttgaatcaaaaaatgtatactttttttgtatctaccttctaagacatttgtcttgagaaattaatgattctacaacataaatagtcattgtgaaaggaaggaaaaagataacagagggctttcataataatcatggactcaagattatctaatttaaaaagacatatctcattttcctttatttaaacataaaacaaatgagagaaaacagaaatagctcataattttatttatctgataaaacatgctgacataaaaatataattcatgcacccagtaagaaaatcaaaaaattaaataaaggtaaaaatgaaatataaaattctctttcctctagtctcttacccccagacatctagaatctctccttaagataatcactgttgacaatttcttgagtatctttttaaaaatgaccttaatacacatcccccgtatagaatatagatcttaaacaagttagaaaataaaattttatcttttagtattacacaaaaggatgttcagaactaggctttgtattttttttttctagagataaggtctcactgtgttgcccaggttggtctcaaactcctgggctcaagcaatcctcccgcctcagtctccaaaagtgttgggattacaagcatgagatgaagtcttgcctggcctaggctttctatttttgtttaataatttaccttcaagatattcttaacttttaacaactgtattgtataaatatattttttatttaaacaataggctaccaataacattaataacatatcttggtttatgtattttacaagattctccatgtgataaattccaacctgagaagttgctatagaacatatgaatttaacattttttaattgctgcgatctaatatgatcctaaaacatggccctagtttatattcctatgagaatgtctaatacctacactcttgctaacattgactgctattgcattttaaagactaatttgattggattgatgttgaacatcttctgttactcctggccattgcatttctttttctacctattaatctcccttgtataatattgcattattcgtcttttttgtctcatttatcgacaaagattaaagttattggcagtagtgaaaatggagaaaaaaatcaaaattcaaatactgtagagtacaatattttggagaataatttgattctatatattgaaatttaaattgtctttaatctttgacccagttattctatttctagtaatttttctacccaaataataatacaggaaaaaaacctttacagagattattcttataatgtttgtgatacaatatttacaggcaacataaattctcatccagagatcagagtaaatattatatagtatatctgtagaatgaaatgtaccttgctgtttaaatgaataaattagttattatcataaaataaatgtcatgtaaagacatttattttatggtgtataaaattagaaaaacaagttattaaaaataacatgattttttgtaaaatgcttttattttgtttttaattgacataataattgcacatgtttatggggtacagtgtggtgctttagtgcatgtgtacattgcgtaatggtcaaatttaaaaattaaatgtattgatagaaaaagtgtttggatatttgtatcctaaatgctaacagtgatgatatctggaatgtggaactgctggtaatttttccctttttcttttagagatttttgtacttatttttaataataaacatatactaattttataataaaaataacaatgaagtcctttccattttgaaaaattaattccaatagaaaaatattgtacttgagccactttccagggttttcttattcttagtgctggtataaggtaccagtgatattatattttcagatatgtttggcttttctgccttatggttgaagatgagcttaggaagtattgctgcctaattttcaggcttttgagccaatgcttggtgcacaaaaagcaccacatcaactttaaacagaatattctgcttctttagactgtatttcctactttttatagtatttattagcgccagaactctgtgactgtttcccaaagaacaagagagaaagatcaaggaaagtgagaagcaatgaaactagatttaattaatactctggcttgtcagcagccagatttgtttgttgaagaagttgaacctattagcttaaacagggattaactctgccaactctgacagagcatggacaattaagagtttattggaaattaattgaaaataatacagtgttgtgaggtgggatgaagatgatttcctttaaggaaattatgccaagtgttttgaatcagccaaggataaacaaatgcagactatcatttgatggaggtattataaactgataacatgattcaaagtataagaatggcaaattgtgaagaatgaatgaaattacagagataaatagcaaaaatgtgaaactaaaataaagaggaacagtgagtaaatggggttagctgagaatatggtttaacagggcatactctattcatttatgaagaaattttaatcctcaaaatgctacttgtcttagtctgtgtaggctgctgtaacaaaataccacaagctgagtaacttataaacaacagaaatttcttacagttgtgcaggctgggaagtccaatatcaaggcagattcagcatctggggtgaggttcacccttctggctcatagatggcaacttcctgctgtatccccatactttggaaggggccaatgagctctctgggatctcttttataagggcacaaatcccattcatgagaatcttgtcctcatgacctaatcacctccccaaggctctatctcctaacacgagtagcttgggggttaggatttcaatatacaaatttggggggacataaacagtcagtctgtgacattgccatttcgtcagtaagaattttcatgaactcactattaagatttatgtttaggttttttatgtggatgttctcactttataatattgtttgtctgcatagtttaaagaaaaggacaatgcccaattagaacaggaggtgtcttttgttggccagcaaaatattttaagatgccttgagtgtgaccctacatagagatcattaaggtaacatcattttgttcttgttatagatccacatgtttcactcaagatcccagaaagaaaatgtatgaaaacacattggaagacaataatccatccttacaatgttagccaatgtttattattgctttctatgtgtgaggaattgtgttaaacacttaaaaagatgttatctctcataattatcataacacctgaagaagtaggtggggtgattttctccaatttagatattataggaactgaaacacttgcccactaaacaggcaattgaaagagataggatttctatagaaaattgccagctccacagctagtgttcctattctcatcattagtgttcccttagtggttttgatattacacctaatactatttaatacaaaattaaagcacccaccctattctgggatttactgtcaagaatagagcactgagcctgataaacagtatccactttggaatgcatgtttctatccagctacttaatatgacataagttcattggacattaaggccagatttcttgacatgctttaccctcaaattaacaagtttggcttattcaattgtggacctttaacccttaggccagatagtatatgaggcctagagtagtggaaaaaggtaactggatttacaaaatttgactcttcaaattctgtaagaattcaatatattgaggaaagtttaggtgcatagtaaaattataatttcatattgttgcacagactcaggcagatgaaagagactccaatagtggtcaggtagtacccagacagtcagttgattgtctctgtgctgaaaggatttaagaatgaagaagagtttgctccaatgtatgtttcaatatctcattgttttacaataatatttgaaataatacctaggaacccaacttacaagggatgtgaaggacctattcaaagagaactacaaaccactgctcaaggaaataaaagaggacacaaacaaatggaagaacattccatgctcatggataggaagaatcaatatcgtgaaaatggccatactgcccaaggtaatttatagattcaatgccatccccatcaagctaccaatgactttctttacagaattggaaaaaaactactttaaagttcatacggaaacaaaaaagagcccgcattgccaagtcaatcctaagcgaaaagaacaaagctggaggcatcacgctacctgacttcaaactagactacgaggctacagtaaccaaaacagcatggtacttgtaccaaaacagagatatagaccaatggaacagaacagagccctcagaaataacaccacacatctacaaccatctgatctttgacaaacctgacaaaagcaagaaatggggaaaggattccctatttaataaatggtgctgggaaaactggctagccatatgtagagagctgaaactgggtcccttccttacaccttttacaaaaattaattcaagatggattaaagacttacatgttagacctaaaaccataaaaaccctagaagaaaacctaggcaataccattcaggacacaggcatggcaaggacttcatgtctaaaacactgaaagcaatggcaataaaagccaaaattgacaaatgggatctaattaaactaaagagctcctacacagcaaaagaaactgccatcagagtgaacaggcagcctacagaatgggagaacatttttgcaatctactcatctgacaaagggctaatatccagaatctacaatgaactcaaacaaatttacaagaaaaaacaaacaaccccaacaacaagtgggagaagtatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacactttcacactgttggtgggactgtaaactggttaaatcattgtggaagacagtgtggtgattcctcaaggatctagaactagaaataccatttgacctagccatcccattactgggtatatacccaaaggattataaatcatgctgctataaagacacacgcacacgtatgtttattgcggcactattcacaatagcaaagacttggaaccaacccaaatgtccatcagtgatagactggattaagaaaatgtggcacatatacaccatggaatactatgcagccataaaaaaggatgagttcatgtcctttgtagggacatggatgaagctggaaaccatcattctcggcaaactatcacaaggacaaaaaaccaaacaccgcatgttctcactcacaggtgggaattgaacaatgagaacacatggatacaggaaagggaacatcacacactgtggcctgctctgtggtggggggctggggggagggatagcattaggagatatacctaatgtaaaagatgagttaatgggtgcagcacaccaacatggcacatgtatacatatgtaacaaacctgcacgttgtgcacatgtaccctagaacttaaagtataataaaaaaaaattaaaatattctgcagtcacagtgactgtcttggcttctcttaatttatgaggacctttgtcttatagactcttttttaaaaaaaaagatggggtcttgctatgttgtccatgctggagtgcagtggctattcacaggcttgatcattgcatactacagtctggaactcctggactcaagtctcccagtggctgggaatacaggtgagtgcctaccacacctagcctgatttacagatttttgacatctattatagttaaatgtattttcagcatttgcatattaaaggaataatattgatgcttaacttcattagtgatcagggaattccaaattttaaaaaatttttttcatctcttacagtatatttaaaaattcattgctgataaggattcagggacgccaacattgtacattggtagtgaaaatgtaaattggaaactttctgtaatctgacagtaattatttttttaaaaatccttttgaacttgcagttctacttttgggatttgaatttatggaaagtaaagtgccagtgagaaagaatattgttgccccttgaacaacatagggttaggggagctggcctcccacacagtgaaaaatccacatacaacttttgattccccccaaactactaataacctattgttgaccagaaggcttactgataacatgcgttacatttaagacatattttgcatgctatgtgtattatatactgtattcttacaataaactaagctacagaaaagaaattataatcaagaaaattgtaaggaagagaaaatatatgacccattcgttaagtggaagtggatcatcctaaaggtcttcatcattgttgtcttcatgttgagtaggcagaggaggaggaggaggagctggtctttgtgtcttagggtagcagaggtggaagagggtgaagggatggaaggggaagcaaaagaggcaagcacacttggtgaaactttacaaaaatacatcattatttctgtctattttgctttttcatttctctaaaaacatttcagtgtagtacctatcagtcttccaccatttgctttagtttcagttcctgtatcattgaacggtctatgtcataaaagaagtcaaaagtagtcttgaataatcaaagctcttttgccagattgttgaatgccaatttgttttctggcactgcttttcctatgtcttcttcctcattatctggcactggttaggaagcactcatctccatgaagtcatcttttgttaattcctctggtgtggtgtgtattagctcttaaattcctccaagatccatatcttgcaacccttcactccacacctttttttcccttcatatccatacttctttccatggttttctctaaattgggtttgtcgtaattctgtagctatgcacaacatctggacacaaattgtacttttgtccagcaggaatttattgttttgagtttcatggttttctatatcaactgatgacatcttgaaaggtgtaagccttccagacttccatgatgttctctgtattgggtttctcttttgcaatgttgacaaacctttccatagagtgccatatgtagagccttaaaggtccttatgactcccttatctagaggctgaagtagagatgtgtttgggggaaaaggagaacacttcagtgcctttggtgttgaactcatggggttctgggtggccagggggcattttccaattaaacaacaacaacaaaaaactttaaaaagcagtcccttactggcaaggtacttctgacttcagggacaaagcactgatggaactaatccagaaaaagcattctcatagtccaggccttcttgttgtacaaccaaaagactggcaactagtgtttctcttttccctttcaagactcaggggttagcagctttatagttaagggcagccctgatcataaacccgactacatttgcacaaagcagtagagttagcctatcccttcctgccttaaatcttggtgcttgcttctcttccttagtaataaatgacctttgtggcttttatttttccccctggaatagggcactttcagctgcattaatacctattcaggcagatatcctttctcctcaatgtttttcttaacggcatttgagaattcacttgctggttcttggttggcagaagttgctactcccattatcctgacatttttaaaaccaaaccactttctaaaattatcaaatcatcctttgctgccattaaattctccagctttagatctttcaccttgcttttactttaagttgtcaaataatgacttcgctatttcttgaatcaaataagagtctataggtatgtctttcttatagcaattctgtaccccacataaaagctgcattttgaatatgagataagaaaggacaaggttttcatgcctgttggcacgaaatgaggccttatgaatttctcttttttttttttaagggaccttacactggattcatttattttgaaatggcaggcagctgaagaactcaatctataggaagcaatctaactttttctcataatgtcacaacttttctctgcttcttgggagcactcccagcatcacttgtggcactttgtattggtctcatggtgttattcaagatttatagtattacactaagcacaatgaaaagagaactgtgaaagaacacactatttacttagatacagaatttactgaagagaccaagtgctcatggcagatactggcaacatgagctcaccacagtagcaacagggggtggctacaaaattattataatagtacatacactggaaagtagacgctggagaatattccaaaagatgccagggttggaggggagtgagggttgaaaaattattattgggtacaatgttcactattggggtgatgagtacagtaaaagctcagacttcaccactagcaatatatccaaataacaaaacaatcatataataaaagtatgcttgtacctagcacatttataaaaataaaataaaagtaattatttgggtagtacagtatgtgctatagttaattgtatgcagttgtggtttaatacagcatctttatgtttgtttatgtttctcttgactgcaaatagtgacttgtacggtttgtgtgcatacattttgataagttttaactttttataatagatttgtgtatattttatggtagtaaatgataaaatagattaacatatacatatactttatgcattcaggatgtacatagctttttcttaatttttttcttatattctaggctatgcagttagtctgctagttttttcaattgcaattctccaaaactttttctgatatatttatttttttaaaaaaataccagtgtaggcggacctgcacagttgaaacccatgttgttccaaggtcaactaaaaaatctgaaatctgaaatgcttcaaaattggaaacattttgagcactgatatgatgccacaggtgaaaaatttcacatatgacattatatgactggtcacagccaaaagacagtcaaaattttgtttcttgcacaaaattttacaaatacataaaattaccttcaggctacatgtatactatatgtagggaatgtaaataaatttagattgggtctcattcttaacatatcatgttatgatatgaaaatatttcaaaatttgaaaaaatccaaaatctacaatatttttggtcccaagcatttcatataagggataccatactccagaatgttagaatgtttatggctactttgtttgtagtacagggggaaaaaaatcatgatgagtctccatcagtaaaaagatagtttaaaaacttgtagaatttagtcatatacatatatttacacatgcatatatgcacacatattatttttctctatatagagaaactgtgcattcatttaaagtgatatttcctctttttgttaattgagttggagaaatgttcatactgtattgataagttggaaaatcagtttgtttacatgaggtgaagtggaaaagttaaactacattataaagtacattataggcttttcaaaggacaaaaaagtgtcacctgagatgaggcaatgaagtgctcatggccattcatccctattttacaccaatagaaagaaaagtttggaaaatgttggatttctcaataaaatttcaaggaagtagagataaatatgttactgtactaatgtattcatgtcttcttaagagaaatggaactccaaatttttagaatttttgaataggaatgatagaggaaagaaaacagaacactagtgactccggcattgtctgaagctgaggactgggctgtgggtaacccacaggtgatattactttagcctgaataatccagacgttatgatgttttggcctctgtgtccaagactcttgtagatttcttgtcaggccacaattctttgagtgagagtaatattttttcagtaggcaaaaatcccttgaaagatcaatccagggacatttataataaagataggattagaaggtagactttaggctagggttagggttggaaaaatcaaaacacgttgttctctttagagtgagaaattggtttatcccagactttgaaagataatataatctataaccctctggttacgggaaagaagagacctacatgtggccatcttgggagcaaggcagagagcaggctggaagatcttctaggatggatatggacttgtgaaatgcagtagttaaacaaagttttctcagagttacatttgccttccatcattcctgaacactcatgtcatcatgaaattagaagagctgatccaatactattgataaggaaagagactctcctttccccaaagcgagagatagcagcaataatcagataatggcccagaagatggatgatcatacacacggcttgtgtgaggcttatggaagataaaacaaccacaatatttcagaaatgtttatatgttgtttacagttctaccactacaaagccttctagaatgtgagacagaatggtgtgatgattattcttagtataaccagattaagtaagatttcacaggtggagttaagaattaagaatttttgattcaagagtctcattcaccctcttccttctttgttaatagttctgttaggatctgcctttaatttgtcttttcctttagggcgctcaaaacaacacaaggattaaatgcctttctatggtcaaagttctctccttatttgccagttctttttttcatgtcccaatcataatcttaatggtatcgttgatcactcaagcaactaaccctgaagactgcccagtcacaggagccaatacatctttttatgtttaaactcaatcacttcaaatgttgatcttaccttgcataatagaaattagtcgtagagactgtggtgggatgagatagcattgcgggtaatctggctcagctatggctgagtggaagaaacttgcatcaattatttatggttaatacagagtatcctagatcgtagttgtggactgaatacagacattcagctccctcccccactgagctctcataacaatgcagggactggaaagaatgtcagcatatgggatgggagaatgagaagacgggagcttcttgggcagatattacgtagtgaggaagcagtgggtgagaacattcagtgagagaccacaatgtaaggagaaagtctatctgaccagtggaagcagagactccagactcagaacctttggtacgaagagtaactacagcaaacgggcaaagaatagattgtgaatttggaggttatgtgcttccttctggcacatgaaaaaactcctaaagctttttgtgggtccaaaatgaaataaaaatctttccccattggtatgaaaataagttaattagcttttacaatggtttgtttttgtgttactagtttccagttgtggctgtttctctcagtttctctctgttttggtttgtttgtttgttgttgttttccttctcttaggaaactttggcagataattgggcacagaaattggtcattttttaaacactctaggttagtgattctcatagtccctagacatcggtatcagtattacccggcaacttgttagatatgcaaattctcaaatcttacctactgagtcatatactgccaagtgagccaaggaatccgtttaattaggctttgcaggtggttctgatgcacactcaagttgaaccactgctgaagccataactattggagacaatcttgcatagcttgaaaaatggagagctctaactgttggtagggctttgctttatttgtcttaagaaagcattaatgagaatagctttgtgtttctttgaagttctgggtgcttctgaaaactctaaaggttttcaagcatttaaatttctctagcccttttctcaaacaaacaaaaaaccccaaacaaggaaaatctcatagaaatataaaaatgagttaaaataagttgtgaggaatattctatacatcaacagtaaagtattactcaacctcaaaaattacgtctctaccataatctataatctgactggataaggactataaataaatagcatatgaaagtctacaataaagcagggagaaaatcatcactggctccgaatttgataatgacttcttgttgtatgtatgtaaatatcttctgaacaaattattgtacattttcctatctctggagaaaattaatgaattaggttaaacaatttcttaagtttaatggagcttctgttttccttggcttatgtatactagcacaggtaacttgctgaactgcagctcagaagaaaaaatctatagagaggtttagttctgaggtgaattaatggactttgttgctatgtcagaaggcgagaagcaagggaaggcaggcgggtaagagaatcacataacgcaaaggacttcagtgcttcagaacaaaattgaagcgtttcaaaaatttgactgaagtaaagttcagtaatatttttaatcatgggaaatccttggataaatgtatatggtttgataattttggtttaaattaattatgttttttctctgattttatcacaatcttagaattaatgttagcatatttttctggtttataaaatattttaacttaccagagctttctagatgtcccctactcgatttaaggctcagctgaattgaattattaaactagtattttttaaaacatttgttcctgtaacttgagatggggctacaaataattatactgtataggtaaaaccacacataccctacctggtaaaaaattcaaatttcatatgtaacacaattttcatgtaaatttttatattttagtataaattctctgcagtgtgtcagtttaaaatgaattttaacatactagttagctttatgagcttggctaatatttcattgagataattagtgaaaaatctttggataagtctcataaaatttttaacatatccttgctgcatatttttacacattatagagtggctatcaagtaggagaatgaacagtatgtaaaagtacccttagttctgattaatgcacatgttcttttatactactttaagaaattaagtcagtttgagtatttagaaaagtgcatgcaatataattaatgtgtttttgcttatcaaggcaaagagagtaattttgtctaaaaggcaaattgtagagttttgctagaatataaaactgaattttaaaatacaaatttaagggcatacaataattgtagaatatctgagggaagtaaacttcatttgctatagcttataatagctgcaaataatgagtttaaatgagcaataaaacgtttataatttttggactaactttactcaatgttaattagtttgggcataaaacataaaagaacttttgagtcttttagtcaatttgttaaatggatggtctcaaaaaagtcatattagtatttgggttacctttttgataaaataataaatcaatctccatatattagccttttttttttttttgagacaaaggcttgctcttgtccctcaggctggagtgcaatggcgccatcttggctcactgcagcctctgcctcccgggttccagtgattctcctgcctcagcctcctgagtagctgggattacaggcgcctgccaccatgcctggctaatttttgtatttttagtagaaatgggatttcaccatgttggccaggctggtctcgaacccctgacctcaggtgatccaccctcctcggcctcccgaagtgttgggattacaggcgtgagccaccactcccggccatatattagttttttagcaaaaatttaacacttgtattctccacagtgtcctaccggattagatatagctctcctggactaaattgtttctcacccacagcaatattgccatccgggagaaaagagatttatagtagtttactttgtactcctagaaatcctttcaagaagtataaaagtgaatacatacatatttaaatgataaacatttatctttgtgataaaatagttaagtttccatgtgagtcaggtttaccacatgagtgatgaaccagctttaattaacaatataaccattctcctctgtcactgtaggctgttctaaaaaaagaaaaaagtttacaaaagccttaattaccttatgctatttggggagaattaagcaatgaatggagtgttgcatttaacaggttatagaaaatttttctgtgtccagcatataatcaactactaattttcagactggtttggcacaatatagattttctgccactgaatagaaactaaaaaatttgaaagtcagaaaattatttcccaggttctgaaagatatcaacaaagatatttttaattgactatgtatgattattgatttgagatttaatataccatgtctatgagaattctttgtaatacttctgcagtgtaatttgctacataatgaaaattcatttttcataataaatagttttcagaagtcatgttatctttcttgctcccagcaagtagctctatttcttggccacattgaggaatcaaaatctaatgtaattcttctaaatagaatagagaacacctagagtcgctgctcctatgacaaatctttggataacaactctcatgtgcgtaagacattttctgatctcttctgtacttcaacttgtaaagaactttggacattacagtcagaaagtctgctattcctacaaagacaaaaggggaagcctctaaattccctgagtagtggggataattagctttcatactcatctgctgacccctgattatcagaagacatttttatctctttggcatgccccatcacctgctgtctgtctccaaaagacctgtagatcagagcaggcattgtaaggcagggacagttcctgaaatttccaattaactgatgatgggaaagctcagaaacacaaactctggggagtggctgcctggtactgctaatactcctgctggaaacaggggcacctgggctacaaacaaacgtaagactttggaagaaggtgcgttaacttaattctgcctttcacatgtgagctcccaatttcccttgtggctatgagccacaagggcccaaattcaatgggagggtggttcgggtctatcatgacaagccaggatggaggagacagaggtcagttattgggagcccagattcttgccctttagaaacatgtgctgtagcagagaggaacccactacagctgggatcctggactgacacagcgagtgggtagtccatccagggtcacctgattgatagcaggcccttcacatctgcagcccccacctgtgacactgtttttgataccatattccccaaatttaaccctcaaatccaaaatagtaaaactactgagatgttacttatgaatacagtatctctgggtttctcagatggctgctgggaaactccagagatcctcctcctagctcttaacatgaagatatattagaaataaaggtaatgttttgcattctccagatatttaattggctcaaaactatgctcaatatagtggaagctgctgtgtttttcaaggccatattctgagaaaatagcaataaaatcatcttaaattaattaaatgcaataattatgtatgattactgtggctatgttacaataattgtgcacttctcaggttggattcaggcatatttatgttcatgtacaaagactggtgcaataaatgtcaaccaactgattaaaaaaagtaaacttctcagttggtgacaaataataatatctactttgtggggaaaattaaaggccctggagaggtatcgggatgcactaattgttcttcatgtgttctgtcttttacggtaatcactgattaaaatttcattagatgagtatgtattacacctcaacagagaatgccactgtcccccattgtgatgtcgtttgctatggcaaaaaattaaccaaactttacagttttattattagcaacatctcctccccctatccccgctgcttttttttttttttttttagatggaatctcgctctgttgcccaggctggagtgcagtggtatgacctcagctcactgcaaactctacctctcgggttcaagctgtcctcctacctcagcctcccgagtagctatattcaggtgcccgccaccatgcatggctaatttttctattttcagtagacacagggtttcaccatgttggccaggctggtctcaaactccggacctcaagtgatctgcctgcctcagcctcctaaagtgttgggattacagacatgagccactgtgcccagccctcctttccctttaagcatacctaaaagcctctctacaaagcgccaatcagaatttgagtcatctggaagaaatatcaaaagagctccagtaataacggtagcagacactgttgatactattgataccacaggaaattgactcatggatataggcctccaagaataggctgaccttgtccccacagacaatattccaactatacgaagtaaatgagtcaggagttccaagacactcacaatgtagaagcggatgaattcatgaaagtagactgcttaactcaagaccagcacgacaagaggttgttatttaggattaaagggcctcagtaaggcaatttaattgaggttagtttaattttctactttaatgaacatgagaacaacccattttctttcttcttaatctacctttaatctccaattaaatttacaaattattaaatttgtaaaaactaaataaaacactctgaattcttagtgttgagggaaaaaataccttgcagaaattcttaatataaaaacaaagctaataagttgccaagaaaaacatacaaataattattttgtaaagaattgtgacatacaatatttggttttgtctattaacatacccttaattagcaatattggttaaatcttgcacaaagtttctttaataaaaacatttactttttgtgactatgtagttatttatattggttcaataagaatttgtcctcccttctacctgaatatattactaattagaaatttttttttttttttgagatggagtcttgctctgttgcccaggctggagtgcaatggcgtgatctcaactcactgcaacctctcaatcttgggctcaagcacttctcccacctcagcctcccaggtagctgggattacaggcacccaccatcatgctaggctactatttgtatttttatagagacggggtttcaccatgttggcctggctggtcttaaactcctgacctcaggtgatctgccggcctcagcctttcaaaatgctggggttacaggcatgagccaccttgcccagccaggaagaatcaattttttaataaaaaatttatatctgtgctacaaattcaatttaactagacaagacaaatccagtaataagaataatttctatgtttttcacgcagaagcgatgcctataacatccttctaggaaaccaatctggtgcttgctctatggactatgcaatctcaggcttggaggtaagaaagaatgtcctttcttggcagagcagggacaccgagacattggatatcttttattaaaaaggatacatttgcattataaatactgcagatgaaatcaggtagaggtgaacggactggtttggtctgctctaaactgagctgttaaacatgtaaaagtaaatttaaaccacaagggctttataaatctatagatagacgtaaacttgtgagccttagtttattgtttcatcaaaaaaatactaggaggtcattaaatattaatcaacacttcttagatctgtgcaaataaaatggatcaaattaaaatgtaaaatcaatagtactgattaggaacattgttcagcaaatggaggtagacaaacatgtcctgtagagaaggaaacatgaccgcaagatgaagtgtaaaaaccaaagtgacatcggggcctgacaccattgtcagcccattcatcatgtcccactgctgaagaaacagagaaaaaaaaactctgcactctgacataaagaaacaataaaagggtctctctgtctacctgcagtcctccaaatgaataaaaccttgagcatttcctgagagttgctaactccttaatgaaaatcactttatccttgactttacaatgctgtttattgtctgaagatatgtcatgaactttctgaatataataaccatgataaaattgctgttttctgccatgaagagattaatataaaccctatagtcttcataatattgtttgtcttaaaaagttctatttttttaattttttgggcagttcttttgaagaatgacttcctcacatttctttgcaagtaaatgcctccttctgcttatttttccaacatgcttttgtttctgagcctttctttcatgctctatacacacaaatcagcaggagatagtacctgcagctgtatttggagtttactgcctcaatgttcactttcaatgaaagagcgtatttcttaacagaagaccagaaattcatgctgaaccaataaattgtcctctatagttctcatctgcaaggaggatttaaatatttctagctcagtagttcagccctgaagattatttcacccccactgctaatcccgacctaatctgtttttgtgttgttaatgctcctatatactagccaggtcagtaattctgtaacaggcttaatttcttaatattttaggccatgtgttaattttactatttcttagccattttttcctcaatagttttaaattgcatccctgcttactctcccttttactggacgggcttcctctgtttactaatacaattccccaaattgattcatccacttgttgaaatacctaattttaggccctgcactgacagcttgcctaggcttatacttgtgtttggtgttgcagtcttcagattctaaaaacaccatctagaccttacattacctccagccagggctattcccccagggcctgccttaagaagcagatttcttttcaagtttcatcttcttcccatttatttcatttcatgacagttagagaagctgtatactaacgtgacaaatggtaagttagcagagaaaaacgttatttcaggataagttcagggaaagctttttggaggaaagtcagctcacattagtcctgatgatggatagtgtatagagactacagatgatggaacgatgaagtggaaactcgagtggctacatacggacattccacatagaagcagtgtgagcaaaaccaccaagacaggaaatgagatggaattgataaggcaatgcaaataattcaggttatttagatcatcagtgttgggggaagctgggtttatgggaatcaatggttaatcagaatgtgagcaccattggtttggtaattcatggaagaggttatcattcaacagggggaggggcttctcgattataaacatgtctgaaggtcactgaacatcaaggctatccttcagttaaaatcttattaaaattatactgacctctgatgaccttcagagagctccagctagatggattgatgataagagaaattcgagaaggcaatggggcaaatctttgtgcaaatctctgttatgtcatatatctaaggcttctgctggatccagtgatttgtttgttctgactgtagtacaaatctattggaacaataaatctagttataataaatgacagagggcattgaagcagatgcaagaagcaaaatatacaggtgtaaagacaaactatattaggcctcccatcaagcttctctaatattttcacagcacagccctgcctgacttctctctatctggataggccccttctgtttgataaccagttctctgatgttgactacctgattctctagtcctcaagttgactcatcctgtttattgagagtgacatttttagactactaataatatttatatgtaagaaagaaactgggtttttatataaatatataatcttttcaaataaaagattataatcaaggaactgtaaataatagaaaaattacataacgtttccctatttggggattggttaaatgcaatattatagaagtctgaaaaaataatgacggtattacaaaagaatataaaaataattgaagactaggaattatgtctaccaactaattcagtcatttggctgtttattctcatttgaacagtagtggattaagaaaaaaacaaaaagactttcgacttccatcacagggagaaaaggatcaagtacacattagagaaagctgatggaaatgatttctagtttcagtttctattttctgtcaattaaccatcattttggtaaacagcctttttaaatgtcttttcttttaatttttaaatttttactttaaagacagggtctcactatgttgcgaaggcattggcctcaaactcatggactcaagtgatcttcctgccatagcctccctaggtgcatatcaccatacccagctattaatgtctttataaaagcatttttaaccctactggtctagctattgcatcaaataaatagctaattccattgaggaaggattagggactcacgagtgaaaataaatgttttatttggataatggctacaaaatctcaacagtcaaaataaataagagattaaaggcatgatgatgacttaaaagataaagttaggtagaaatgtgaactaagggaaatgactcaacacattcagcaacacaaaactgtggcctaaattcactctgacagttgttatgctatctcctgctgcccgagtaaagtaagttatgaacaagacacatgaaggggatcaggcagacatatggtcaaatgctttctgtgcaatatgtctgtctccatattatcttctctctcattgcactttggacatttttattcttcctgcagatctatttttatgaagcaatgtgatttaaattaaaagagcactgaattctcagccagatatttgagttctagttgaagatttatcacctagtggttatgagatttggggcaaattacttaatctctctctttctttaccacttcatttgtaagttttcttgcctccctacaggactgtattggggatcaatcaatgttgagttgaaggctacatggtttaagttggcttaatggagaagtggtaaatcacttaaacgggtagaacaacacagtgtagaggatgttgggctgcatgaggaagtgtggaaaaaaagcatgccatgaaaatatcatcacaatctcacatttcttcatttatttgcacactctgaacacatgcatgtgataaggactgtgcaaggttctcaggatacccaggtaaaaatcaccacttctgccagtcttgactttgcaagcttgaggagcaggcctggagaaatttggctattaccacaccaaagttgttcctcacattccctttgacatatggtctcaggaaaaaatgaaaagagtaaaaaaagaaaaaaagtccttcatttttgaaaggaaaagtcataattaatttctagaaggagaaagaaaaaaagagataacagtgtgtgaaaaggcttagaaaatgctagagcactacagaaagataatgtgagattatgtctaagagtagcttggttattttgcttttgttgacaaagtatacctccttcattttcatagttgtcataattctttccatgattttcttagtgggtttgtttaggagaaactgtattctttctttattcatctaactctccttaactccaaaagatgcttcttaggataacattttaaaaggatatacattatgcacatttttaatgcttctatacaggactgaaggccaatattaccatgataataaggcatgtaacaaaaatttgttctgcagagagtgagaaagcgtgagggaaaacacagtgcaggattctatgctgttgcccaagaacccagacaggcaagtgaaataatagagcagacatttcctgaggctgtggtcgatatgattaggagatagtgggtaaaaatggcctttaaactatatacacatgagaagatagatgtgaaagcccattgcaaaggcaataaaattatgcaaatataaaatatcactattaaaatgtatgatgaattgacatgccatgaaaacagttccagtgctgggccagaaatcaggaaacatgggcttttgatttctcaccattaaaatgaagaagttggatttatacccaagggtaccttgtgggctgtatggcttctaagtaactggtcataacaaaagggacacaatcaggtcagtttcaaaccaagaataaaatgggaaattaaagaactgaattggctactttctgctcaaatgattgttaaaaataaagtttaaaaaaagccccaaggactatgcagtgcagtgagcagaggcccccgatattaaaaagaaaacaaggaaaatggattcctggtgatagaagtggtgtgggggaagacaaatagtgtggctgcaaatggaacaatatgcaaaagaaaagtagctaaatatagctcttttttgggaaagagattgtgtctaagtccatcagtggaaaggcaacttaattgttgtataagtctgttcaggttgccataacaagataccatacaccaagtggcttaaactatagaaatgtatttctcacacttctggaagttgggaagtccaagataaaggtggtagcaaagcggatttctttctaaggtctcttcctatggcctgtaagtggctgtagattcactgtgtgcccatgtgaccatttcttcgtgcaccagggggaaggcggacaagcaagctttctagtgtctctcttcttgtaatggcattaatctcagcatgaggacaccactctcataacctcttttaatcctgattacctctcaaaggccccagctgcataaatcatcacagtaggtgttagggcttcaacatttaagtgcgggagttggtgttcacatttcagtcaattgaggtgacaattgaaatgtgaaaggaaaaccatagttactagagagaacggttgtcttggggaggatcactggacaggactacggtcctgtccaggttgttatggcaacctgaacagacttatacaacaatccagtcctagaggcaatacaacttctctgctgattccagattctgagcgcctctcagtccttggttgggttgttttgatcctgtccatattatatttataaatattctcttcataaaactctctttaggccgggcgcggtggctcacgcctgtaatcccagcactttgggaggtcaagagatcgagaccatcctggccaacgtgatgaaacccgctctctactaaaaatacaaaaaattagccgggtgtggtagcgggcgcctgtagtcccagctactcgggaggctgaggcaggagaatggcatgaacccgggaggcggagcttgcagtgagccgagatggcaccactgcactccagcctgggcagcagagcgagactccatctcaaaaaaaaaaaaacaaaaaaaaaaacacaactctctttaaatcacacatccgagtgtgtcccttgtttcccaccagagccaagactgaattgagatgatttcttaaggtcaggttgatgtcctaatccagttgtgctgctataacaaaataccacagagtgagtaacttataaacaacaaaaatttattgctcacagttatggaggatggtcagtccaagatcaagttgccagcaggttcagtgtctagtgaaggcccattcctctgtcatccaggctgaagtgcagtgttgcaagcttgggtcactgcaaccttcacctcccaggctcaagtaatcctcccacctcagcctcctgagtagctgggaccacaggtgctcaccaccatgcctggctaattttttttttttttttttttttttttgtagagatggggtttcaccatgtttcccaggctggtctcaaactcctggactcaggcaatctgccagcctcctgagggagtgctgggattacaggcatgagccactgtgcccaccccctttttccagtattacctggacaatgtgtctccctgtcagtatccagggaatggcacctggatcaagcatttagtgttcagttgctacactctcacctaatccctcattttcaatattttgccatgttttccagtgacccaactggccaccatgtcacagactttatggtctccaagggagacccctccatttcatgttttgtgatttgagcaacagactggaatctacttgaaatttgcaaatggtctttgacttgggctttccaattttgctctacttcacagtgttttctgggttatatacaagggagatgatccagtcatttgttaagcgcctcaaataagacatgccctagatgtttttttgcttgtttgttttgtcaaattgggattatttttgtgtctttggagaatataaaatactaatatgaggtaagcactaaggttctgagatggccgtggaagagatgacaaactccatcaccatgcctgagagtgtccaatcgtctctgcgggggccacatatttttgtattacactgtatttgaaataacaacaacaacaaaaaacccttcaagattcataaaattggacaactgtctttgtaacacttctagtggtaaaaccagtaaggatggctagtttgcaacccatctgagcagcctctctggtttcatagatatgttttctctctgacattgaatggctttcaacttgaagcggaatgctacatcacaaagataaacaggtttgaaaggaaccggttttccttgtaatcctaaacgttcaagtctgcgcattaaaagacattatctgaagaagggtgcaaaagcttcctgttggccgccagaagggttctctgcaggacacagatcaagtaccacagtcttagggggagaccagacgcggggtctctgcgcacctccccaaaggacaatggcaggaggaaaaggagaaagagacagacgtcacttccttcgccagctccggcagcgggttgatcggctgagtcggcggagggtggggcggaagagcagacggggactgggaaaggcgctgttagtgacatcacggatagggcgatttctatgtagatgaggcagcgcaggggctgctgcttcgccactaaggagttcccgtgccgtgggagtgggttcaggaccgctggtcggacctgagagtcccagctgtgtgtcagggctaggagggctggggggggcggggaggtgcgcggggcaagtgaccgtgcgtgtaaagggtgaagcgtgtgaggctgtggcggggcggaggtgcaaaagctcatacttacctggcaggggagatactattatctaaacgaaggtggtttttctcagggcgagggttatccattgtgttccggatgtgctgacctctgcgatttccccaaacgtgggaaactcgattgcataatttgtggtagtgggggactgcgttcgcgctttcctctggtgcttttgtggtgcgaatagtaggtgagccgtaagtgtttttgtaattcagggtgcgggctcgtgttttgtggctgtgttctgtccggtcagttgtttccgttcgcaacggttagttttcgtttgtgaggccatgtttggggacagcttagaactatccacttactctcttgggaggcgaatttcagtctctgttggttggggtgttctcccaggttagctgccgctgtacttgctaggtggagctcagggatcaagggtcgggagctttctggtttgttcagtgctcccagggcttctaacatctcttaaaaactctggtgttttctgtcatcctcggagttacctcttagcctctgttttttttgttgtttttttccccccctccctaagacaagtctcgctgtaccgtccagtctggagaagtggcgcgatcttcccatctcaggctcccgagtaggacaaccacacgccaccacacctggctagttttttctctttttttttcttttcttttctttctctttcctttctttttcttttttcgtagcggtttcaccattctgctcaggctgggctccaactcctgggctcaagtggtccgcccagccttctgaagtgctgggattacaggtgcgatccatcttgccctggcagctcctgcttttcaccacagcattcacgggagtttgtaggatttctgtgttggggaaacgtgtactcagttaatagagccaggtggaagttgtactcagaactggtggttttctttggaatgaaaaccgtgcatgttgggggctcttagtgtccccgttcggttgtagacataacacccttgctttgtgtagggggagggctttgcccatgccctggtgccctggcgcagggcatcgaggcctgcaggtcagaaccgcagtctaacctatgtcttggcggaataccctgctaattctccctggaatgtaagatgggaggtcttgtgaggaggtttctacaagtaagaaaacaaatttccattcggtttttattgacaaaattgaaaattataataactgagtccagcctctcagatgacaaatgtcttttgcactgagagctgggaaccgccgcttgcctcagctcctgcatgcaggtgcagccctcgcttccctccacactttctccagcgggtgtcagttcctccacaagaggcagacagcgttctgcagaaccacagcgctcaaggccttcgagagccaaaaatctcggagcgagctgccctgtcctggctgtacctcacgactgacctagaaatggcctttgctgggagcaaagggtaggggggagattgtcgtcggagctggggcctgtgcactggaccaggttgaccacgggaggggaggtacccagagttagaagggggccaagcactgagacctcaccatcctcaatctccaaaaggactcagagagatgcagagactgagacaggcttcctttttcaaggaaagagaaaactactgaggaaggccccaggggctctgaaccaaaatccagacttttttttccacctgcagctttttgtttttatttttgcttgagaaggggtctcggtctgttgcccgggctggagggcagtggcgcaattttggctcgttaaaacctccatctcccgggttcaagcaattctcctgcctcggcctccctagtagctgggactacaggtgcccgccatgacgcccggctaatttttgtatttttattagagacgaggtttcaccatgttggtcaggctggtctcaaactcctgatctcaagtgatccacccacctcagcctcccagagtgctgggattacaggtgtgagctaccgcgcccagcccgcacctgcagcttaatcccatttcgctggtgcaacttcatccttccgtatgctcaggccaataaacagtactgtaggctggtcgttctttgacccccatacatcctattggtcggaaaattatgttttctctttggttaaccgcagactttgatatgcacactctttcttggtctgaaacccacccaatagtcccatacgtagatttttggataaacatagaaatggacccttctgatctgaaagtttgaaactcgatatttgttttatttgagttccttccttcaggcctctcaaaaaagatatcaaagaactgaaagtcacccagacaatgagatgccggacccctcattcatcctgattgcttccttgcccctccctagttcctgttttctttcttttcttttttctttttttttctttttgagacagagtctccctctgcctcccacgctggagtgcagtggcgctatcttggctcactgcaagctccgcctcccgggttcacgccattctcctgcctcagcctcccgagtagctgggactacaggcgcccgccaccaagcccggctaatttcttttcgtatttctagtagagacggggtttcaccgtgttagccaggatggtctcgatctcctgacctcgtgatccgcccccctcggcctcccaaagtgctgggattacaggcgtgagccaccgtgcctggtctagttcctgttttcttacacattgtcacattctttccctgccatctaagcctctagttttggttggtcagggagatggatttgagactgagttctcatctcctccgctgcagcaccctattaaagcctcttccttggcaataaccatctcagtgattggttttctgtgtggcaagcagctggaaccccaggtctctgaactttggcaaaggaatctcctgataaaggcgagatcgattttactgaccaagctgaaaacgatcagacgtttgaaagccttaatctcggagcctgtcggagtttggtctgcccttgaggcttttctttgggcctaccagtcaaaatcagcctggccaaacctgtcttcaaggaccaggggcagggccggcttctcccgccgggtcggcagccaccttccccttccctgtgacttgaagagaagcttcagggggcgtttattcaatttgcgaggagcccgcgaggagcaggtgcgcggtgactctgtggatcccaccgcacccgctgccctctttggtcctctcgctgtcaccggcgggcagtaacgttccgggtgagctagggctccgaagacagcaggcagggagggaccagtgggtaagggcaccgcccgtttaggtcctgcgcaggagggatccgaaaaaggtcttgaagaaatagaaagggagggccagatgcggtggctcacgcctgtaatcccagcactttgggaggccgaggtgggtggatcacgaggtcacgagttcgagaccagcctggccaagatggtgaagccctgtctctactaaaaatacaacaagtagccgggcgcggtgacgggcgcctgtaatcccagctactcaggaggctgaagcaggagaatctctagaacccaggaggcggaggtgcagtgagctgagactgccccgctgcactctagcctgggcaacacagcaagactctgtctcaaataaataaataaataaataaataaataaataaataaataaatagaaagggagagttggaagtagatgaaagagaagaaaagaaatcctagatttcctatctgaaggcaccatgaagatgaaggccacctcttctgggccaggtcctcccgttgcaggtgaaccgagttctggcctccattggagaccaaaggagatgactttggcctggctcctagtgaggaagccatgcctagtcctgttctgtttgggcttgatcctgtatcacttgattgtctctcctggactttccatggattccagggatgcaactgagaagtttatttttaatgcacttacttgaagtaagagttattttaaaacattttagcaaaggaaatgaattctgacaggttttgcactgaagacattcacatgtgaggaaaacaggaaaaccactatgctagaaaaagcaaatgctgttgagattgtctcacaaacacaaattgcgtgccagcaggtaggtttgagcctcaggttgggcacattttaccttaagcgcactgttggtggaacttaaggtgactgtaggacttatatatacatacatacatataatatatatacatatttatgtgtatatacacacacacacacacacacacacacagggtcttgctatcttgcccagggtggtctccaactctgggtctcaagcgatcctctgcctccccttcccaaagtgctgggattacaggtgtgagccacctcacccaggccattttaattttaatttaatacttttaatttgaatacacaatccaaaaatcatataacaagtacaggaaacccactttatgccaagtttacaaaaacaggaaagatatgtcaatgacaaagcgtcaaagtggcaacatcctaaagtactgagagaaaaaaagttattctagaattctatgccaaattgaaatatctttcaaaaatgtgactgaaatcaggacatttaaagacatacaaaaaaatgacagaattcaccgaaccacactacaagaaatattaaaggagtcctccaggcctaaggataaggataccaaacagaaatctgaacctacacaaagaaatggagacgactgaaaatcgctatgtacgtacttggatgttggggtttataacatgtccaaaatcaaattccctgacaacactagcataaaggccagaaggggaggtataatgtcacttgatggcagacagataaagatgtattctagggaccctaaagccatcactgacataacaaaagaaagagttacagctaataagccaaataaggaaagaaaatagaatgatatatattaaaaaaaaatgtaatcgctgggtgcggtggctcatgcctgtaatcccagcactttgagaggccaaggcaggcagatcacttgaggtcaggagtttgagacctgcctggccaaaacggtgaaaccccgtctctactaaaaatacaaaaattagcccgatgtggtggctcgcgcggacctgtaatctcagctacttgggaggctgaagcaggagattcgcttgaacccgggaggcggaggttgcagtgagagctgagatggcgccactgcactccagcctgggtgacagagcgagactctgtctcaaaaataaataaataaataaacaaacaaaaactgtgtaatccctatgctggagcaactgctctccaggcctctaccctatagaaatacacaaatggccaatgagaagtgtacaagaatgatcactgccgcattatttgcaatcataaaatagtagcgccaaagtaatttcaaagatacatgaaaatcgttttatttatttaacaaacacaaacaattgaacaaacaatggaagcaagtccttttgcctaaaggaacacagagggtcatgcggatgttgctcctccaaggatttcggtgttccccaacggctagttttgggtctagttcttctggaagaccttattcttggggagctacaggttctggcgtttggggctctttcaggttctatctccattttcccctcaattcctccccattctgctataataaaaaaaaattctcacctccggaagatcccgcctgtgcctccccgccagcctttcaggaggtctggacgtctggtccaccgctccccggcttctttcaccgcttttgcttttcccttcccctgctcccgccctccggcctcaggacccgaccaccgcccagctgagcccccgcggctccacggcgcagaaggtgcactggaggccctgcccgttgccgccccgcggggtgccaagaagtcaacgtaaataaatgctttgtaaaaggaacttccccatggaaaaatctctcatgatttccattctcaaggctcttcaaaggactaaaagctaaaaggatggattcattcgacaagtcctagtcctgcgccctggtgagtgccagaccctgctccccacgagggggacccacgagccaccctcaccacgatccctgctctggtggagcccccgtgcggaacacaggatccgaagatggcagcggaagctccgcagcggccccaaaagcgactgggcagggagggcacaggctccctcactgggtgaagtcggcgcaaagaacgggaagagccatcccgggagccaccgggcgttcagcctccctagggcccccaggcggctcgggccggggtctcaaccggggcgtttccgggggtttctgaagcaggcgaggggcagggcgggccaaggccattcggctatccttctggctccagaatctcccaacgcgcaggtgtccaacgtgaccagcgcgacttaccactccaatctctccggtcttccaaggccttgctcagtcgtcctgccgggcgggccctgaggatgcaagggacggaggaagtttcgtgcgtgcgcccttcctatagcgcccagtagaactgactgacagtacctgtctctgtggcgtagtcggttagcgcgttcggctgttaaccgaaaagttggtggttcgagcccacccaggaacgcttgttcgagcttttaaagtattcatgcattgtcaatcactagataaatggggaaaattttatcttcctggagtcctaagccactaatttgtgacttatccatgtcaagggccagcctacctccccgaccggattcttaaccgggtatctcctgaaatcctgggtttatacgtgtgtaactcaggaatcctgaaacagagacctaggaacccacttctggtgtgataaaattctaattcagtccgttatacgcttaaacgagtaatttacatgcctccattttttcatattttaataataggaggtcagtaatatcccgaggatgtgcctggatttactgattgctctatcaataatgtgaccagtggaatcattcatcatcatagtgatcctctccatcatttttgaaaagagtatttttcctcagtttgtgcatgatttatttaacccttttcaaaatgtttttgttagccaggcatggtggcatgtgcctgtaatctcaggtacttgggattctgaggcaggagaatcatttgaacctgggaggtggaggctgcagtggaggctgcaccagtggaggctgcaccaatacactcccgcctgggcaacagagcgagactccatctcaaaaaaaataaaaataaaaaaataaagtttttgagatgaggtaggtttcattgttttaggattacaaagaatgctgcagccacctttcttgtacacatatctttggtcattgtggaaatgtctacaccgcagatatttctatagtgtagggaagttgatgcactattgctacattatagggtttacatgatgcttctaatttgagtacattccgcaaatgtatctttcacgggagccgtaccaaataatattccaatagcaatatttataggaggaaaaatgtgcagaagtgcaactgagcttcgtgcctctccatggggcccatgttcataaaatggtggcattagcaatcatctgagagtggagtttgtggccctctgacatcaaaagctgaagcagaggacatgaaaaccctcactgtgcatcctctctagtctggccagaatcattcctaggtcggtggtctcttatcaggagggaatgctgcttgcttgttttgtcaaaatcacaaaactgaggaaaagcatcaggccgttggttgataacagtggtgaagcaagtctttccatagggctggtttgttgttaacccttagggaaaaaaaaaaagccgtttttttttttttgagacggagtctctctctgtcgcccaggctggagtgcagtggcgcgatctcggctcactgcaagctccgcctcccgggttcaggccattctcctgcctcagcctcccgagtagctgggactacaggcgcccgccaacacgcccggctaattttttttacttttagtagagatggggttttaccgtgttagccaggatggtctcgatttcctgacctcgtgatccgcccgccttggcctcgcaaagtgctgggattacaggcataagccaccgcgcccggccaaaaaagcctaattcttaccagctggtgccgtgcagttccaggctcttggtgtcccaaacaaagacaccaagagcctggaactgcaccaaaaaccaaaaccaaggtaggggcaagatgataatcacagaatgtcaccggtatatgtttaggttcaaatactattatgagaagtggcaggtaaaggaggtaggaaaaagaaaacacatcatgtaattgactgttgtatggaaatatttgatgctgaaagttataatttaaaactataaaccaaatattagaagtgtgtctagttcaaagggaggaaaaccatcaaaaacatttttagtgcaatatttaacatgagctatacaacccttcctaaatgccaaaggcacacacagacacacacacagacacacacacacacactcacactcacgaagaatacaaatgactagaaccaagcaatgtaaatacattctgctacgtatggtaaacatagcctacaatgtggaagagattagaaaataaacatggaaatgaaatgtttttattaattcgcatcagtacccaccaaaaccaatcagcataatcaaatattataacactgaatgtaaaaaacaatccaaaagtccagagtgatagcaaaaggttttaattgtatagattaaaattaactttggacaaaaattaaaactcaggcagagaatgttttcttctttttgcaacagcagacactagtaaaaacaaaggcacagtaaaaattgagacccaaaatttgcagtgtagagatatgaatataataatagacacaggcagggaggattaataaatgataaaatgtttagaggatgatcattagaatacaggatatttatactcttgaaaaccgctttcccaagtacttcattataagtaaggtgtctctaaaagggacagatctcctagacccctccttaaccaagtaaccagtcctgatatcataatggtgatggacaaactagaccttctctgcccgcagatgggctgaggttggaaactcacagcattgtctctgcagtgttcccggcaaaacgtttaggctgaatttaatcatgaagacattttcagacaacttcagaatgtagatcattgagccagacagctgacctgtcctctataaacaagtccatgtcaccaccatccatgacaacaacaaaaagatgaggaaatatttggggttcaaaataactaaagaaatgcagctacattatctttttactttttttcaaccgaaaatatctcttctcctttttgttgtgtgatttgtggtgatatggactatgtgaaggagacaggtcagttgtcctgctcagtgttctacattctgcagttgtctggtgattacctcctatgaaactcaggttaagcgttttctgcaagaacatggcattgctcatattctgcaccggcagagtcctgggtgacatgctgtctcctgccagcggctcctgactcctgttctctacaggatggaattgagaggagcagggctaaggcctcccaatgctgtttgtccatctagctgtggtcttcctaagtactgacaccaattggaggctgaaggactgtggcttctctaaccaaaggagcctagcgggttaacaattgtcaagagcagttggtggttctgaaatacaatcctcagccaaggatccctcctgtgttacagatggatcagctaaaacaagccaacactgaagacacaaagaatgaggttaggttcattgaaaccagggtaacacctttggatgagctaaacacaaagatgacaatgaccttgagcaggtatagaagctcagagacatgcctgcaaaatgacatccctgaggaattttgtagctacccagagatacgtggttcaaattaaaatgtctgactgatcactcccggcatgtgctgcacagttatgtgaacgtgtcacacctaacgtgggtccattgtcttcagactgagcacaggttgccactggcatggtttgagaataggaatagagccatgcccactgacccatcctatgtctgggcttccaaatggaactgtactttcattcaaatcttcacgtgcctataggtcctgcctgcaggaatgacacctctcggcttagtaagggctgcttattgtgggaatatgactcccatctggaacaccaggtggagacttgtcaccgtcaaagtaaaaaacctattgtccacgtaaagggcgaagctgatatgctcttcctcaaatgagtaaaacacacttctgtagtgctggaatgagtcaggtagttcaaagtacattgacggagtcgaataacatatatccagtgagtcctgcaagacttcaggctcttccacttccatcagcatgctgttgagcctgcaaaaggagacaaaactaaagaagcagccagggaaaatcggacaccacagagccccactagatttcagaagtaacataaggaagtggttagaaaagaaaaaggatagatccattaatgaggtaaaaaaaaaatttattgcctttatgttgggatagaacagggccaggtagaaaacaatgaaagagaaagacagagagagagagacagagacagagacagagagaaagtgacctagtgaattggccaggtgacatactggtaagggagtcaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctgtggtacgttagtaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacactgtgagagatatatttcaggaggcctgaaggctggtcatgatagaaattcctcggtttttctcccagaaactgtgggtaaaatgtccctattctagtagatcgttatcccaatatcatttgtcccaaatttgtgcaaacagttatgccatatttttacaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgagaataggatcagggcgccacaggtatggcctgagactaggaagagagtcttgctcactgacccatcccttgtctgggcttccaggtagaactagagtttcattcaacctacatgtgcgtataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacagagagagagagagagagagagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgagaaggggaggaagaaatggaaacctaaatatctactgcaatgaaaaccaacagcaatgttagtaggaataattcaggcttggttgaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttaattcctgcaatacattcagacagggacagacaaaataagccaattcacctacacccataacagtccactgtctaatccccacacagggatctcaggctcctcagcatgagaacaggacaatgtgagagatgtacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttgagtccaaatcatacttctgtgaattttttacatctgcctgggtccaatgtgctgagagcgggctcaggttgccacaggcatggctggagactaggaatggagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcatagtaaggtactcactgtccacgtcaagagccaagccaaggtactgttcctccaatgagtaaacagcactgctgtagggctggcctaagtcaggcagttcaagataacctgaaggagtcgaataacatctacccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttaggttgggatagaccagggccaggtagaaaagaatgaaagagaaagacagggagaggcagagagagagagagagaggagaaagtgagctcagcgagttggccgggtgacacactgatgaaggggtcaaaggacactctgagttagtgccctcgggacacacagggaacagtgatcatgaaaagagtggactcaataattttccataaacttgctcaagattccatgcagttgccatacagcctttgaggtatggtcaacctatagaaagttagtaaatgataaggggaggaagaaatggaaacctaaacatctaccgcaatgaaaaccaacagcaatgtcagtaggagtaattcaaccttcgttgaaaacatgaaattgaacacactcttgttttccctggacctggcatctccaggtgtcaacacagaattcagcatccataattgctcaaagttacctggggcatgatgggtcttggtcttcttccacttcttggtacttttcaatttctgcaataagttcagacatggacagatatattaagctggttctcctacacacataacaatccactgtctaatcttcacacagggacttcaggctcctcagcatgagaataggacactgtgagagatattcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaattgcccccaaatggttgctaggagaaaaactgcactattcagccctgtctcatcaaatactcagattgttcatggtagcgaggattttagacgctgaaattagagtgaaggatgaaatctacaagatctacaaaattgagacaaaatcagagttgtgtgaatttgtcacatctgcccaggtccaatgtcatgagagtaggattagggcgccacaggcatggcctgagactaggaagagcgccttgctcactgacccatcccttgtctgggcttccaagtggaactagagcttcattcaacctacatgtgcctataggtcctccctgtggcaatgacatccctcagctcagtaagggccacttgcagtaggaatatgaccctaaccagaagactcagtggatccttatcaccttcatagaaaggtactcaccatccatgtcaacagccaagccaacacgctgttgctccaatatgtaaaaggcacttctgtagggctggcatgagtcagtcagttcaagacaacctgaaggagttgaatagcatctatccagtgactcctgcaagacttcaggctctttctcatccaacagctccccgctgagcctggaaaagtgggaaaaagtaaagaataagccagggggaatcagaaaccacacagctccagctagatttcatggctaagataaggaactgtttaaaaagaaaaaggacagatccattactgagggaatgaattattgcctttaggttgggataaaccagggccaggtagaaaagaacgaaagagaaagacagggagagggagagagagagagaggagaaagtgagctcagtgaattggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttactaaatgataaggggaggaagaaatggaaacctaaacatctactgcaatgaaaaccaacagcaatgtcagtaggcgtaattcaaccttcgttgaaaacatgaaattgaatacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatattcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcatggtagcgaggattttagacgctgaaattagagtgaaggatgaaatctacaagatctacaaaattgagacaaaatcagagttgtgtgaatttgtcacatctgcccaggtccaatgtcatgagagtaggattagggtgccacaggcatggcctgagactaggaagagagccttgctcactgacccatcccttgtctgggcttccaagtggaactagagtttcattcaacctacatgtgcctataggtcctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatatgtaaaaggcacttctgtagggctggcatgagtcagtcagttcaagacaacctgaaggagttgaataacatctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaataaaaaggacagatccattaatgaggtaacaaattattgcctttatgttgggatagaacagggccaggtagaaaacaatgaaagagaaagacagagagagagagagacagagacagagagagagacagagacagagagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctgtggtacgttagtaaatgataaggggaggaagaaatggaaacctaaacatctactgcaatgaaaaccaacagcaatgacaggaggagtaattcagccttcgttgaaaacatgacatcaaacacactctggtttccctgaatctgttgcctccaggtgttaacacagaattaagcatccacaattgcgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacactgtgagagatatatttcaggaggcctgaaggctggtcatgatagaaattcctcggtttttctcccagaaactgtgggtaaagtgtccctattctagtagatcgttatcccaatatcatttgtcccaagtttgtgcaaacagttatgccatatttttacaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgagaacaggatcagggcgccacaggtatggcctgagactaggaagagagtcttgctcactgacccatcccttgtctgggcttccaggtagaactagagtttcattcaacctacatgtgcgtataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgcttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacagagagagagagagagagagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgagaaggggaggaagaaatggaaacctaaatatctactgcaatgaaaaccaacagcaatgttagtaggaataattcaggcttggttgaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttaattcctgcaatacattcagacagggacagacaaaataagccaattcacctacacccataacagtccactgtctaatccccacacagggatctcaggctcctcagcatgagaacaggacaatgtgagagatgtacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttgagtccaaatcatacttctgtgaattttttacatctgcctgggtccaatgtgctgagagcgggctcaggttgccacaggcatggctggagactaggaatggagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcatagtaaggtactcactgtccacgtcaagagccaagccaaggtactgttcctccaatgagtaaacagcactgctgtagggctggcctaagtcaggcagttcaagataacctgaaggagtcgaataacatctacccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttaggttgggatagaccagggccaggtagaaaagaatgaaagagaaagacagggagaggcagagagagagagagagaggagaaagtgagctcagcgagttggccgggtgacacactgatgaaggggtcaaaggacactctgagttagtgccctcgggacacacagcgaacagtgatcatgaaaagagtggactcaataattttccataaacttgctcaagattccatgcagttgccatacagcctttgaggtatggtcaacctatagtaagttagtaaatgataaggggaggaagaaatggaaacctaaacatctaccgcaatgaaaaccaacagcaatgtcagtaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatattcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcatggtagtgaggattttagacgctgaaattagagtgaaggatgaaatctacaagatctacaaaattgagacaaaatcagagttgtgtgaatttgtcacatctgcccaggtccaatgtcatgagagtaggattagggtgccacaggcatggcctgagactaggaagagagccttgctcactgacccatcccttgtctgggcttccaagtggaactagagtttcattcaacctacatgtgcctataggtcctccctgtggcaatgacatctctcagctcagtaagggccacttgcagtaggaatatgaccctaaccagaagactcagtggatccttatcaccttcatagaaaggtactcaccatccatgttaacagccaagccaacacgctgttgctccaatacgtaaaaggcacttctgtagggctggcatgagtcagtcagttcaagacaacctgaaggagttgaataacatctatccagtgagtcctgcaagacttcaggccctttctcatccagcagctctctgctgagcctggaaaagtgggaaaaagtaaagaataagccagggggaatcagaaaccacacagccccagctagatttcatggctaacgtaaggaagagtttgaaaagaaaaaggacagatccattaatgaggtaacagattattgcctttatgttgggatagaacagggccaggtagaaaaagatgaaagacacacacacacacacacacacacacacacacacacagagcgagctcagtgaattggtcaggtgacacactgatgagggagtcaaaggacactctgtatttgtgctctcaggacacacagtgaacagtgatcatgaaaagcatgtcctcaataattttgcgtaaaatgtggtcaagtttccctgcagttaccatgagaatacagcttttgaggtatggtcaactttcactaggttagtaaatgataagggtaggaagaaatggaaacctaaacatttactctaatgagaaccaaaaagcaatgtagtaggcataattcagacttgtctgacaagacaaaatcattattttcagcatgtactgttttccctggacttggcatctccaggtgtcaacatcaaattaactgtccacaatttctcagactcacctgggacctgttgcctcgtggtcctcctttttcacttgatcccaccgatgtcctgcaaataaattcagatgggccctcttacattaagcagttcttccttgcacacagaaacattcctctgtccaatcctaacacagggacatcagtcttgtcagtgtgagaacaggagactttgagagaaatattccagtaggcctgaggtcaagtcttgagaaaactggcttgggttctttcatgagccttgggcaaaattcccctgtgttggaatgttatcttccctatgtgctctgtcctaggtttatgtacacaaatgagcaattttttccccaataaattgtaggcaaatagttctaacacctcataggagagatacttcaatattaggcttttctcattaaatacccagaatttgatagtttatgagattgtggacacagagatttgatgaaagggtgcaatgtaccagctcttgagtcaaaatgaaacttggttctacacagaagcatcagctattatggcttttgtgggtgaaaagtcagccatttatctagaaaacataccaggaacatgacggacagatgagctaaaacaagcgaacttagaagacacagaaaatgggaataaattcagtgaaacctgggtcacatctttcactgagaggtagacaagggtgacactggccttgggcaggtaaagaaccacacagacatgctttgggaacaaaactcataaggaattttgtagctggcaagagacatttaattcagatgagctgagctgacagacaactcctgggcatgtgctgcatagtttggtgtgagtttgccacacctgccttgagttcaatgtcgtgacagtcagtccaggttggcacgggcatggcctgagactaggaagagagcaaagctcactgacccaccccatgcctgtgcttcagactcgactccagagtgattgaaatctacattgatatataggttcagcccacagtgatggcaaatctcagcccaacaaggggcacaaggcccaaagattatggggtctacctgggccatgaactggagctttatcaccttcacaatggagtactcactgcctatgtcaacagccatgcagacttgctgttcctctaatgagtgaaatgtgctgctgtaagacttgtacgaggccaacatttcaggaggaattgagagagtcgaataaccttcatcccaggactcctgggggacttcctcctcttcagactcctgcagattcctgatgagccaggcaggacagggatgacagaagatttaaccaacagactttagacaacaaaacctcccagatgatctgatgggagacagaatggagtggtcacagaaaccaaaggcatttttccttcaagaggaataaaactatccttctaaatacagggtggagggtgactgctctggggacagagcaaaaatgggcagcgtgtgctcagtacatttgccacagatgagccaactcagggcacccagactctccctgtaaactaccatcatgacttgcagcacagagaactgacacagggcttcaactactttgcataaattgggttgaattttacatgcagcattcaagtgaagagagttcttgacgcagtgcagacacagatcttgtgtattaagggccccattttcccaatattttgatataatatatttactttttcaatttcttttcttgcaaaaatactagccaacatactaccaacaaataggaagaaagcatatatacacctctccctggatttaaacacatgggagagaataggcaacaccaagaaatccctgtttgagggtctggagtggacttccagcaaactccaacagacctgaagctgagggacctgactgttagaaggaaaactaacacacagaaaggaatagcatcaacatcaacaaaaaagacatccaccccaaaaccccatctgtaggtcgccatcatcaaagaccaagggtagataaaaccacaaaggtggggagaaaccagagcacaaaagctgaaaattccaaaaacctgacatcccttctcctccaaaggatcgcagctcctcgccagcaatggaacaaagcaggatggagaatgactttgatgagctgacagaagtaggcttcagaaagtcggtaataacaaacttctctgagctaaaggaggatgtgcgaactcatcgcaaggaagctaaaaaccttgaaaaaagattagacgaatggctaaccagaatgaacagtgtagagaagaccttaaatgacctgatggagctgaaaaccatggcacgagaactatgtgatgcatgcacaagcttcagtagccaattcgatcaagtgcaagaaacggtatcagtgattcaagatcaaattagtgaaatgaagcgagaagagaagtttagagaaaaaagagtaaaaagaaatgaacaagcctccaataaatatgggactatgtggaaagaccaaatctacgtttgattggtgtactgaaagtgacggggagaatggaaccaagctgggaaacattcttcaggatattatccaggaggacttccccaacctagcaaggaaggccaacattcaaattcaggaaacacagagaacaccataaagatactcctcgagaagagcaaccccaaaacacataattgtcagattcaccaaggttgaaatgaaggaaaaaatgctaagggcagccagagagaaaggtcggattacccacaaagggaaacccatcagactagcagcagatctcttggcacaaaccctacaagccagaagagagtgggagcaatattcaacattctttttttttttccatatgtatagttttcctttattattttttgtgtgtatgtatatatatatatatatatattttttttaatactttaagtcttagggtacatgtgcacaacgtgcaggttagttacatatgtatacatgtccacattggtgtgcttcacccattaactcatcatttaacattaggtatatctcctaatgctacccctcctccctccccccaccctacaacaggccccagtgtgtgatgttcccctttctgtgtccatgtgttctcattgttcaattcccacctgtgagtaagaacatgcggtatttggttttttgtccttgcaatagtttgctgagaatgatggtttccagcttcatccatgcccctacaaaggacatgaactcatcattttttatagctgcatagtattccatggtgtatatgtgccacattttcttaatccagtctatcattgctggatatttggcttggttccaagtctttgctattgtgaatagtgccgcaataaacatatgtgtgcatgtgtctttacagcagcatgatttataatcctttgggtatacacccagtaatgggatggctgggtcaaatggtatttctagttctagatccctgaggaattgccacactgccttccacaatcgttgaactagtttacagtcccaccaacagtgtaaaagtgttcctatttctccacatcctctccagcatcttcaacattcttaaagaaaagaattttcaaccaagaatttcatatccagccaaacaaagcttcataagtgaaggagaaataaatcctttacagagaagcaaatgctgagagattttgtcaccaccaggcctgccttacaagagctcctaaaggaagcactaaacatggaaaggaacaatcggtaccagccactgcaaaaacatgccaaactgtaaagaccattgacactaggaagaaactgcatcaactaacgggcgaaataaccagctaacatcataacgacaggatcaaattcacacataacaatattaaccttaaatgtaaatgggctaaatgccccagttaaaaaacacagaatggcaaattggataaagagtcaagacccatcagtgtgctgtactcaggaaacccatctcacatgcagagacacacataggctcaaaataaagggatggaggaagatctaccaagcaaatggaaaacaaaaaaaaggcaggggttgcaatcctagtctctgataaaacagactttaaaccaacaaagatcaaaagagacaaagaaggccactacataatggtaaagggatcaattcaacaagaagagttaactatcctaaatatatatgcaccctaaacaggagcacccagattcataaagcaagtcctgagagacctacaaagagatttagactccacaaaatcatcatgggagactttaacaccccactgtcaatattaaacagatcaatgagacagaagcttaacaaggatatccaggacttgaactcagctctccaccaagcagacctaaaagacatctacagaactctccaccccaaatcaacagaatatacattcttctcagcaccacatcacacttattccaaaattgaccacatagttggaggtaaagcactcgtcagcaaatgtaaaagaatggaaatcacaacaaactgtcagaccacagtgccatcaaattagaactcaggattaagaaactcactcaaaaccgcacaactacatggaaactgaacaacctgctcctgaatgactactgggaaaataacaaaatgaaggcagaaataaagatgttctttgaaaccaatgagaacaaagatacaacataccagaatctctgggacacatttaaagcaatgtgtagagggaaaattatagcactaaatgcccacaagagaaagcagaaaagacctaaaattgacaccctaacatcacaattaaaataacgagagaagcaaagcaaacaaattcaaaagctagcagaagacaagaagtaactaagatcagagcagaactaaaggagagagagacacaaaaaacccttcaaaaaatcaatgaatccagggctggttttttgaaaagatcaacaagaaaaccctgtttggctagttcacctggctcatctgatggcaagttcctatcttgagaggactatgaaattaaaaccaatacaagtgccacaaataacatacaacattgtaaatcagcacaatttgtagctgggtgaatggaagaaatagttctattcatcacttcctcattttccctaaatctacaatctccagatgtcactactgaattaacagccaacaattccacaacattacctgggagacactggtcctttttcttcctcttcctcatcatcactttcattttctgtaaataaattcagagaagcaggtcacattaagcaattcatacttcacatatgaacaaatcactgtccagtcatagcacaaggacataactattctcagtgcaagaataaggattctgacaggaatattctaggttgtcctagattaactttggtgagaattagatgaccctgctttccagacccacaggccaaaatctccctctatgtgtagaccataatgccatattccctgcttgagtcaaagttaaacaaaattttttccccaaaaaaatctccaaaaattggtcaaacaattttctaagagtgttgctgcgatatggacttatatcaccaggtaacatggacattaaatgtttagaggcatctatacatgaaacacgactgatagataaatttgaacaactcttgctttaaaaagaatctgtgatttgggaggccaagacaggtgaatcatttgaggtcatgagttcaggactaccctggccaatatggggaaaccctgtctctactaaaaatacaaaaattagccagatgtgatgttgtgcacctgtggtcccagcaactcaggaggctgaggcaggagaatcacttgaatctgggaggcagaggttgcaccaagccaagatggtgccactgcactccagcctgggtgacagagcaagactccatcgcaaaaaaaaaaaaaaaaaaaaaaaaaaaaaaaaaatccacgatgctacaaagaaacattggatcagccattgcattgacagggtggagaaccagggtccagccttgctttatggaaatatatcagcaaagtaaagaagaaaagtttctgtcctgatttcagggtgactgtgcagctaagcaagctgacttaaaggagatccagatgaaagctgagagcagtgaagcctggtgaacaatatttccaaatacaaaggcaaggctgccagcttccttaaacaggcatagaaactccatggacattgttcagggacagatgacttaatcacagatgacaagagatattgaatcgaagctaggaggcctgacagatactgcctgtgcacctcctgcactcaggtgactatgagattgtcacacttgcctggggttgagtaacttgatactggggactggcagacaaagtcatgacattagctgagaaggacaaaaaactccctgatatctgtttagaaacccatcacagttttttattcaaatgaatttgtgtttatagagcctgtcttcagagtttatcttcctcagccaagaaagaggtatgagacacaaggaaaacagaggctacctggaataatgtgtacagcatcctcccattcaacatgagaggatgagccaatgagagttgagtcgactttgtcttcctcaaatgtgattttggttttcctatgtggctggttggagtcataagggccatggctatttgaacaagtgatggcacattcctccagtgagtcctcagggacttccttttcttcagccttctgcatctccctgatgagccaggtgggacagagatgacagaagattaaacacagagggattggaccccagggagtcctagctggttttgacaggcggcattaagagagtggtcccagaaagcaaaatggaggttcccattaagagggaacatgcaatcctgttctctctgcaacagagcatggctgccatgggaaccagagaggaagagagcagctgctgttcattgcactggacagataggagctgaggaggatgaagactcagctatccctgtacggtgcagacatgacactcggcacacatagagaaacatgacagctaccgcaccctgtgtctaagctgggttatatttcacatactgtggccaagcgaatgcgggtttttggcccatcatagatgccagagagggtgtgcctcctagatattcctcatatgttaccatccattaattgttcctgagtattcagtgttacctgggggcagacgatttctgcactttctcagccacctcaacttgaacatcttcatcgtcatcgttgtcattttctgtaaatacagaagtgttcgttcagatatttcccacttcacagtctgcaagcacagtcagcccaatgtgcaacagagacatgaacatctaggcatgggtcaccgttcaactgaaaactctcatgttttatctttaacagaatgccctggcatggtttcctgatccatcaggcaatgcatttctgatctggagggccaccatcaagatgtggccaaatattgaaaagaccttttgcttcccatatcactggaggcttgtgcagcctctctctggacgttggcagctgtctcccccatcctgccagatctgattcccaggcacaggcttggtgtcctgtcacggtttgcatttcaaacctaattctttctcttagaagcagacaaacttgtcccacagtcctctatgcatcagaagatttcaagcctccaagtggcttctgctgtgttcttcagggacattctatccatggggagtgctccagtctgaagcacttcctaccacaaaacgcccccacataaagtgccttctccaacatcacacggcgagggacttcatctcattttggaaagcagttgtaagtgttcccacatttgaatgcttcagacccttgcaagagacaatttgtctgccacggagagagagaaactcaggaaggacaagtcattcactctctgacagttactaagaacattgtcgaaaagacagcctgggaaccttcattcttagtccagagctcttttcactctaacaagcctgctcccatcccagcctccttcctgtcctttaaaactagatagatgctgcctcttgctccaaagaccaccttccatcaaggaaggagggacacttgcaatactgtgacctccaaccccatgggtttcccatctccgttcttacccaagaagtcctggtcatgtcatggccacataagcttagtggaaaaaaacaccactgatacaactgtcattgtgaaagtatggaggtctggagtctctcataagcctgggattttgggtcatcagggcctatggccaccttacctgggctgagcttttggacaaggtgctgtgccagtctacacccctcagccagctgttcttggaggtcctgcccctgggacttgtccggctcatccggagtgaggagggcctggagatgctcattcaatgagcgggaggcatctctcccttcccgcaacttctcccttaactgggtcagctctcgttcctgagcgtgaaccaggactttatattgcctaaggtgagacggtagagaaaatttaagagtagaaagagttgagtgatccgctcaaatattgcaacagagatttctgagacaatgtcctcaaggagacctcgaagcagaaggtcagcacatgtttaaaggaatgtctgtggccaagagaaagaatagaaaatggtttacaggcttcctctgaatcagagagggctcttgcaagatcctcgatgatgttccattcatctttctcttctgtaaacaaaagtaggtgtcttcctaattccctttcaaaaagacatcctttcagttcctcactctggccatggacatttccatgtgaaaatacacatagtgcatcttgcggccactagatacaaagccatgtacagaaatgaggccaggtgcagatggggcgaattgaaaagaagaaagaagaaaagaatgacagggtcgagaaggcaacattgattgagtgaaagaatgagaagccgcagtcagtcaggaggtgattctcactaagggtaagtggggtggtgatggcacaccattttgagtatactgaatgctgctgtgtggttcacactcctttggttaattttgtgttatgtaaatttcacatcaacaattacttgtttgaaaaagagaaaacaaggctctgagaaacaactgcaacccatacatttttactatcctcctcctctgtttgataaatatttgtgtgtagcgagcctgccatggcaattcctgcccttcccctggcccagcttagctcttacgtctccccaccgagctgctgtacttcagagatttacacacctgcccccctgcctgcccccatggggtcccctcacctgagctcctcagcttgcttgagctgctctgcaagcttctcctccttgaactgtcgctcattcctcagcatagattttatgagatctttgcactcttcatattctgagaaaagacagacacacctgcctcagtggaaggctggacatgctgctgtggtcattgcctacaggacaggagccaggtccatcccaaggacaaaactctccccagtaccagggtctagacagggatttccacatctttactcttcagtctcctgactttctggcatctgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcggtcttgccttgaacacatccccattaaataaatccttggaaaagaagcagccgctatttccaccccacccccctcgcacgctttcagctttcgtaaatattcagttaaaaatgaaacctctggccgaggcaggggctgaaggccaagtggtttcggaagtgatcctgggtgagaggaggaggaggaggaggaggaagaggtggaggaggagggggaggtcggctttccatttccagatgtgaccgcccagctgctgctcgccgctgctggattccagtttcctccccttctggcgacggattggtgatgacaccgagtctcactttctccttcccccgccgggaccaaccgccgtggggggccgagggtgccggggacggccggagagcgatcacgggctgggcggcggaagccgacgaggggcgagccccgctccggctcaagcgatcacacccctcacggcccgcactccggccttccacacccgtgcacactctcgcccgcgggcggcggcagccgtgcccaggctgctgcagcgccacccgcccgccgcggaccctccgcgccctccgcctagtcacccggcccggccgcgggccgccggggctcgcagagtgtcagccatcccgggcaggagtcgcgtctccccaccccgacctccactcgcgccgggagctgagcggcagtgtaggtagtgaagactccctggggctcccagccttccctctccgcgctctccccccgtcacttttatgaattcgactccactttctaaaggaattatgagtcttgtggcaaacacaaaccggagtggccgggagggggaaaaggggggaaaagaaaatctttaaaaattaaaaaaataataaaacgaacaaatctttacttgttgccacctcagataacacggaaaaagccttgaaattactccagatgtgcaccctccccttccctcagtgcctgagtctttttcctccagatcgaagtatttcagcccttttggggcgccgtttgcgaaacacagccccttttgagggacttcctcctcttgaaaagactcaccagttctcccttcctaggtgtttctgttcatgagaaattgtcagaatcaactggcacgttccagggtcttcctaaaggatggaaacctgtttggcttgctttttaaaaccacctcctttgacagtcagtccagggaaagctacaatccaggtgttcagaaatgagatactgctctgattctcactttctgttctgcctaaggacacctcaggctgacgtagctgccccacctctatattggtttatgccctaggagaggtctccagcaggcacttttcttgttgatcttttctccgctgagaaggctcccgccagtagaccatgactcgttttgctttgcattctcagtgccacgtacagtgcctggaatacaggagggtggcctaaatgttggctgaatgcatgaatggtcatttcttgcagcctcttttcattaccctgtctcatcagctttcttatcagaataagtgcccaagagtgccaaactgtttcagacccttaatcaatttagttctgattctcaccgtgacaacatgatgttcagcacggtaggaatgactgccatctctgaaggagtcttaagattctgtagaatcagtgaaagattctatgttctaacgcctttacctttcaggaaagaaattacaaaatagtttcattgtccagtcatattcactatgagttataagaggaaacattctatctagaattagaaataccatttgacccagccatcccattactgggtatgtacccaaaggactataaatcatgctgctataaagacacatgcacacgtatgtctattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatagatgaaattggaaatcatcattctcagtaaactatcgcaagaacaaaaaaccaaacaccgcatattctcacttataggtgggaattgaacaatgagaacacatggacacaggaaggggaacatcacactctggggactgttgtgggttggggggaggggggagggatatcactgggagatatacctaatgctagatgacgagttagtgggtgcagcgcaccagcatggcacatgtatgcatatgtaactaacctgcacattgtgcacatgtaccctaaaacttaaagtataataataataaatttaaaaaaaagaacaaaacatcacattgtaccacataaaaaaaaaaaagttggattttgcaaggaagatagacatctgactaaagtttggcctagcaaggaatctttgttagtactacttcttgtttaaggaaagaagagacactcatctttccttcaaacaatataagtctcttttcttgtttgatcaccttttattcattaaggaccagttgaatcatcagttgggacttggtagcagaggatatttcctggatagtgtgagctatcaggcctttaatgtgggaagtttagtttctataaaaataaaattaaaaaagattaatagttggaacaaactataaagacagtttctgagcccagagggcagctgatcaataagatttctagatgctgggcttgtagtatcttcagctggagtgagaagaggcattggattagtttgcagtttgaatgccataaagatgggccacacacaagctgttgtggtaatttttctgaagcttatgtcaagtcatccagtttcagtttgaaggacttcaagaaatgaaaagtttataattttagtgattccaagccagaatagcaggaaaaaaatgaaatattaatttggagtgttgtagctaaatattgtagtaagctagaaaaattgaggatctattgcagattgcaggcagataataaaacctcaggaaaaaaaaaaaacagctagaatctaatattgggtgcactgcagttttctcccgaaacataacttttctctctatattcactctcatttctgtcaaagataatcaaagtcagattgatttgtttgctaaataagtttaatctcattaaacttgtactggttttgtacacaagtgcagttaagagtagtgattgaccatttaggctcttttaaaggttgcgtttgtcagataagaaatctcagattaaactttttgtttttgtttttttagacagagtctccctctgtctctcaggctggagtgcagtggtgcgatcttggctcactgcaatctccgcctcctgggttcaagcgattcttctgctcagcctcccgagtagctgggattataggtgcgtgccactatgcctggctcattttttgtatttttagtagagacagggctttcaccatattggtcaggctggtcttgaactcctgacctcgtcatccacctgacttggcctcccaaagtgctgggattacaggcgtgagccactgtctccagtcagattaaacttttaaaagccacctgaggctgggatacaagcccaaaacttgtcattagtctgcacctgttacatttatagatttagataaatttctctcttcttgaggtccctaaaatatcccaaggtttccagacccaccaagcagtgacattctttacttacctgtaagtctgggaaccctagagccagtttttccaagatggtactttattggttccataaagccaaccttagtcccctaaagccttctggtcatatctgaaaacatgatgtttcagtcaaagccttggtgatataacctgtgtttccagtttgtcctgttacaaagacaacagattcttattaaacttatgcaaataaatacattgccataaaaataagaatatgcacaaatagtttccaaattctggagggataagttagggagaaaaagtaaatgtttccattttgcacaaaagtattctttactgaattggtgtaagctagagatagcttaaaaaaaagttttctgaaatctggaaaacaaaacatttaaagaactagcaatgtttccaacaaaaactcattttaaaaattattctcatcagttcattcagtaccatgtaattaaatcttgttttgcttgatcttgggttagtagttacatgaacccatcagttttattagagttctggaaattcttaccagtccaattgtatgacgttaaagttgttcagaaacctgtattccagaatagtcataagagtattttccataaatctccttgaagaagaagccattttggactgtagctaatttcaaatgcttttagagaacaattaaattaaaacaataactgtctacagatgacaaggacttaaaatgtccatggttaaaaaatctaatgagagttcattacaatgatgcaatttataagaaaatttggttagcatggcatacagcattttaacataataaccaaaattatgactgataacatactagatttctaggaatctcatacaacttttgtacacttatcccaataatatatccataaatataacttaaagatggcttagcatcactttttatttgaatgctacacatataatttagcatattaaataaatctaattggtttaatctctctttcatacaaaaaaaaaattctttgtggctttctgagggtccaatatggagaatcctaagttaatttgaggtcaaaaagacttaacttagaatgtgattttgggaagattgtcaaaaatgtcaaaaagtttaaaacatttaaaacaaatatgaccatagttatctatttaataaaagctccattaaaagattttaaaggcaaattcagattacatagttgtgaacaagaacttagctcctttaatattgagaagactcacttttcttaagtaaccaaaaacctaataaaacaacatgaaactcaagaaattatcttgatgaaacagagtctctgtttctgaggccaattacttaaaaggaaaaaaataccctttacattctcagaccaacattccaagaaaactttaccattttaacggagaagatcaaattctacttttgaatcaatgtattactaaaactaagttttaataaaaccttataaataaatctatccaatctcagtcagcttagaccatacaagataagattttcacaatccttctagacatcttttcttatttacttttgcaacagacatacaccagacaattaagcaatttacttttactacatattctactcttaggttgaatttatggttttatggccttaaacatctaacagtaacaacacaaacttgtctaatcagcaaagccaggtaaaacaagtgtatgctgacaattctgaaaatgtttctatttttattttaccaatattttttaaactagtttttatttactaaggaatatcccagattatgtgaacttaaaaaaaattgggtcagtttctacttttctgaaaattttatacattcttatttgtttgagtgctcatttatccctagccaatttgggtattttagtttggtaataacgttggaggtagaaaaatatcacatatacataacataataacatagatacacacatgtacacatacacaaacatatagagtgatgtaaccagatcttatgacttctcatttaaaaaattttaaccaggccaggtgcagtggctcatgcctgtaatcccagcactttgggaggctgaggtgggtggatcacctgaggtcaggagttcgagaccagcctggccaacatggcataaccccgtctctactaaaaatacaaaaattagctgggcgtggggcatggtggcgcccggctgaggcacaagaagcacttgaacccaggaggtggaggttgcagtgagccgagattgccccgctgcactccagcctgagcaatgaagtgagactctgtcccaaaaaaaaaaaaaaaaaaaaaaaagtttttaaccatgaggcagtaaaacagagtaatacaaaaatacaaactcactggtttatctccgctttatattgttatccaaattgtgtttctggtgaaaaagggataagttgagttgacctacataacaaaggctaaagctttttaccaatatttgtggaggaggttttttaagatttttttttttttttactttatcagtttccaaacagtttctttttttctcctattatcagccccaggtgcttgtttttgaggggcctctgagtcccttgagagccccctcaaaggagggtaggataggggtcctgaagttcagcagaaaagaaacgggtctggcaagagtggacagagaaatagtcagcagagacttgagaagaggggtttcaggtgacagagctcccatgggagaagcaggatccaatagagagaagagaaagagcagagtggttttatagagagccaggaagaacaatttgtagcccagggaatcagggaataacccctcactcagaaaaagagagccagaaagaagagacttctagcctagggactcagagaatagaccactcagaacaagaagcccacacgaagaccttcctgcccagaggattgctttcaaaagaagcctgggactctaccccagcttcagagagaatattcatcccttcagattcaaaatctgtccttagccatcaacgggcttttgtctggagcaatggctcaggaatctgattcaccaatggatccctaatcagtcagaaatgacaacaaagacttcaaaggcatgcatttagggttctgagtgagaggcccaggatccagtgatgaatctgtcctagttgagtttcaacaccatagttgttaaagaaaaaattattcagtgatacttcaaatgcacagtaaagaagactttattcaggaccatcaccatagatataggaaccactgcaacacagtcttggagctggggagagagatgggcttaactctgaatacagcatgcggaagtgggaatttatagcccaggagcaatgcaggggtcagtgaatggaaaatcactaagaggaaacatcaggagtaagggagattctggctaaaccgccctaaaagaattcttgctgaagactggccagggtgatcagacatcacctgcagaatggtgaagaatgaagaacctgatcagatattgagaatgaggggttctttggtaaacttggcagtgttctttgctaatgctggattttgcgaggaagtgcacagtttagcctagctgaagatttagaagcctgactaaagttggccaagcaaagaatctttgttatcaacatattccatcaaacctcacatccctgccttaaatgatcaaaccatccgcactcctgtatgctactgttctccatgaaaagttacttcttctttgccttaaccaaaatccagccattctagaaagacaccagaaggctttctgcagcatctaaaattccccacattctgggcccaaatccttttcctttccctgttgcttttagatccacattgtgtaaccctcatctggaaacctcagtttcttggagtcatttttttttggggggacggagtttccgctcttgttgcccaggctggagtgcagtggcatgatctcagttcactgcaacctccgtctcccaggttcaagcgattctcctgcctctgccccttgagtagctgggattacaggtgcctgccaccatgcctggctaattttttgtatttttagtagagacagggtttcatccttttggccaggctggtcccgaactcctgatctcagatgatccacctgcctcagcctcccaaagtgctgggattataggcgtgagccactgagccaggccattctgtctttttatataatgtaacttgtacttttatgtagtaaattatcacaatggtgtcagacactctgaggaagagtattttactgtatcattcccattacccaatcaggaagtcttaacaggcagattttaacaaaaatataagacacaactgtgccctagcttttctcacatacttcctacctcacacttcacacatttctttttctcagcacccactcttaagtaataatttatttcccctgaatattatttaccttctgtgggctactttacatatcatctgaaagcatgatcaaaacagttatatttgtgaataattttattttggtttatttcttagcagaaggaggagttaatagtaacatttgtaggccgggcacggtggctcacacctgtaatcccaacactttgggaggccgaggcttgcggatcatgaggtcaggagatcgagaccatcctggctaacacggtgaaactctgtctctactaaaatacaaaaaaattagccgggcgtggtggcgggcacctgtagtcccagctacttgggaggctgaggcaacagaatggcgtgaacccaggaggtggagcttgcagtagccgagatcgcgccactgggctccagcctgggagacagagcgagactccatctcaaaaaaaaaaaaaaaaaaaaaaggaacatttgtaatctcccagagattgccaaggaaaacattctcctggctgaatttatgtagagttcatcatctaagcataaaatattttataaaggaatgggccaatcaaataactgctatgcggttgacaccataaaccaagttagcttagtaccactctaaatagttgctgggaatataatgattttcaaagacatgatctctagaaataaataactaaaagagaagcacggtgtcatgcatttatgcatacacataagcagggactagagatcaagaatagaaataaaagaggtttttacacttggggtgctaaggtcgcaatgatttatttggagagaaaacggaagcccttctttagtaaatgcaaagcaccatgtgtttaatgaagatacatgacctaagctttgaagatcgtttaactaattcaataaccttaccaagtatccattactacatctcaacaatcaaatttacagtgacatctttgagttaaatctctccatagatgtctggaaacagcttaattctgttaactgctgcccattgaattatgctttatttggtcgtagaatttcatgtcatctgttagtctccctcacaacttgggagatgttattcctgtattgtctgttctcgttgatgaagagaagtctgtgataaagtaattgtccttcctttgcaggtaatctgccttccgtctctggttgatttgaaaatattgtattagtctttagtatcttgcattttactgtggtatgtctacataaggatttatacttactgagtttgctcagagcttggagtatttcctcagtcttaaaggccctagttgtgaaaatgttactacagaaaaactttctttttttaacttaaaatcctttttattgggaaataaatgtaagattatagataagtttgaaaataaaagaattgttagaacaaaaaatactcatatgcctgttaccctaatttgtctattattattttattaaatttaggttaccatttgttctctctctctctcaatatatatcccaattttcggtctttagatctaaatctttcagcaacctggactatcatggccccagtgtaatgcttggctttgtacctcatgagggaagaaatttttttttttaatcttaagttctagggtacgtgtgcaccacatgcaggtttgttacataggtatacatgttgccatgttggtttgctgtacccatcaacttgtcatttacattaggtatttctcctgatgctatctgtcctccagccccccaccccctgaaaggccccagtgtgtgatgttccccaccctgtgtccatgcattctcattgttcaactcccatctgtgagtgagaacatgcggtgtttggttttctgtccttgtgatagtttgctgagaatgatggtttccagcttcatccatgtccttgcaaaggacatgaacttatctttttttatggcttcatagtattccatggcacatatgtgccacatttttttaatccagtctattattgatggacatttgggttggttccaagtctttcctattgtgaatagcaccacaattaacatacgtgtgcatgtatacatctttatagtagcatgatgtataatccttcgggtatacacccagtaatgggatcgctgggtcaaatggtatttctagttctagatccttgaggaatcaccacactgctttccacaatggttgaactaatctatgctcccaccagcagtgtaaaagcattcctatttctccacatcctctccagtatctgttgtttcctgactttttaatgatcatcattctaactggcatgtgatggtatctcattgtggttttgatatgcatttctctgatgaccagagataatgagcattttttatgtgtctgttggctgcataaatgtcttcttttgagaagtgtctgttcatattctttgcccactttttgatggggttgtttttttcttgtaaatttgttgaagttctttgtagattctggatattagccctttgttagacgggtatattgcaaaacttttctcctattttttagattgcctgttcactctgatgagagtttcttttgctgtgcagaagctctttagtttaattagatcgcatttgtctattttagcttttgttgccattgcttttggtgttctggtcatgaagtctttgcccgtgcctatgtcttgaatggtattgcctaggttttcttctagggttttttatggtgttaggtctttcatttaagtctttaatccatcttgagttaatttttgtgtatggtgtaagaaagggatccagtttcagctttctacatatggctagccagttttcccagcaccgtttattaaacaggggatcctttgagggaagaaaattatttctaatattttaatccagctatgtatgtaaaaagaagtctttttcatattttatctattatttctgtatgattggagtatgagtcaaaacatctcaatataaataaaaagttacatttcagtaatttttttttctaaaattacaaaacactagtggtcaaaaacactactatttccaattctctttactttgttaacattactttttgtacttatgagagaagagtttgcaatccaaaaagagcaggaaggaagagagattagagattttttctcccgcttgctctatacatatgagatatttatatatctatatatcaacagttgacctttgaataacactggtttaaactgtgtgagtccacttataggtggattttttcagccaaatacagattgaaaatatagtatttgtgggacgtgaaacccacatatgtggagggccaacttttcatatgcgagctctgcaaggttgactgtgggacctgagtatgtgcagacttcggtatatgcagggctcctgaatgcaataccccactaatactgagggatgactgtatatgtctctatctatctactctatcatatatatatatatatatatatatatatatacgcacacacacacacacacacacaaatatgtgtatatatatatgtatgtgtgtatatatatatatatatatacttcctatattactttgctagggttgttataacaattactgcagactggatgagttaaacaacagaaatttattttctcacggttctggaggctagaagtgtgaggtcaaggcatcagatgtgttaattttattctgaaatttctctccttggcttttagatagtcattttctcatcttgtcttctcatggacttttttctgtgcacatgtatgtctgtacctaaatttcctcttcaaataaggacaccagtgatattggattaggacccagacatgtgacctcattttacattagttacctcttaaaagtctctatctccaaatatagccaccttctgatataccgggatggcagggggcagggtacagcatattaatttggggaaaggacacaattcagcctataacatatgcaatatattcttctctgatctatattatataacttttacatataatacatatataatttaatatacattttaaccccttgattaattttctcactgcagagaaaacaagaattaaagaaaagcttcaggtgataccatttttgaatgagtaagaattgagcctacccttaacgcaagaatgaagtagaaataaactgacttagggaacagcataaaaaagttctcttatgagtcaagatttcagtgtgatgtcatcattttttccagggattaaatgttagaatatattgcatgcccatattgaggtggaatcataaacttatttcagacttattataatggctcattttcttatgccttcaccattgaacttgtacttagctggggattgagctgaaagtttgccttttctgtatctagcatagttgcaccaaatctgaccttaatcccaaattttcctctctgtaatatcttgtttccaaatgaggctcacattgaattttctcttgttagaaatataactggcaacaccaatcaaaaccattcattccattcagttgcctgtgaacaagcttgatttgctttgttattaatacagcttcttgtggtttaagtagaaagctcttttgtaaatatccctcagtttaagtatatatggtttacatttccaggtaaactataaattatctgagaaaggcccagcacggtggttcaagcctataatcccagctctttgggagtctgagatgggtggatcactggaggtcaggagtttcagaccagcctggccaatgtggtgaaaccccatctctaccaaaaatacaaaaattagccaggcatggtggtgcacgcctgtaatctcagctactcaggaggccaaggcaagtgattaaacccaggaggtggaggttgcagtgagctgagatcgcaccactgcactccagcctgggtgacaagctggactctgtctcaaaaaaaaaaaaaaaaaattctgtgaaaagatctgtgatttccattctcctttatagtaattgttaagcactcacaattagatggttataacaactatcaaagaaaaacaattattttaataaatatttttcaacattttctcctttctaagccctatgctatgcactaaaaactgcagagaaaatcaacacattctctacctcacagcagatttcttggagagagataggggtggggaggggaataagggttgctaaatgttgtcaactttgtaatacaactctcaaagggagatagttattagggaggcaaagtgctcaggctcagatttcaggttgcctagatttgaattctgtcttcactgcttcttttatgatttgcccaaattacttaagctctttaaaccacagtttcctcatccttaagatagggataataaatagaacttatctcataaaattactgtgaggattataagtgattatgaagttgattaaatttccccagtgcttcatacaaagaaaggactcaaaggatatgctagttcatagtaggggcatagaagaagatatcccttctctcctgggatatagggtatacttaactgtccactataaaattgaagataggctagagaaaagctaaaaatgaagaatctaataactctttagccaagagaaaatgaaacatgagggaaagggagaagttccaaatgaggtccacatttgtcgtgggccactgaatggtggtgccattcaggcagaggaaacccagaaggaggagtcattctgtagttagagggcacttaatgagataatattagagataactgaggttgagttgttggtacatatctgggtgcaaagtctccataggtccggaattttgaatagttttctggagtcatctggttattgttaaagccaagagaattggtgagatcacagaatacaataatgatcaataagagggaagggaagagagccaagaatgggagactgggaagcatacacatttaattaaggtttggtaaggtgaaaggtgtcagcagagaatgtaaaggtgaaataatgagagaaaaaggaggacatcaaggagaaagtcgtgttttgaaaaaaacagaaaggacacattttcaagaaagacattgtcaatagtttaaatgtcacaaaatagtagagtataatgcaattaaaaaaacaaaatctgttgcttttgttaattaaataactagtaacctcggctgcagcagtttcagtagagtgaggagagttgacaccaaactgcaccagtggagtgaaaataagtgggaagaaagagtgaggaagtggaggacagtcttttttttttttttaataaaatattttcccaaactgtcttttctggaacttccaacatgtctgcttaagagcttgtctaagttgaattcattcgaacttcttgaacctaattagtttctttttgctgttttttttttttttttttttttttttttgagatggagccttgctctatcacccaggctggagttcaatggtgcaatttcggctcactgcaacctcctcctcctgggttcaagcagttctcctgcctcagcccaattagttttaaagacgctgcatatattggcagggaaaacctagaacacaaagtcaaacttccaattatctcccttcagtgctcaaatcaagagttcatttgttgcaaggaatgggggtctggactccagggagaagaatagagttttagaaggagagttatcctaaaactaaatggaaggagggttctttgagataccaaggatttgcaggactttatttacaattaaatgttagtttcagacagcccaggaggaataggtctattaaaagaaagcaagagtagttggcataaggaaacaatttgcattggagcctgagagtgagtatagtaatgaccacatgagagacccatttgactcaagtacttcaaagcattgccagtgttagtctttgctccacaatcaagtggggaaaaagtgaaatgtctttgaagagcatttcctgtaggtggcctttgaggaggtcctgaaaattccaaacctgcaagtattaatggcaaagaataaaaatttctttatgtaaaatacttttaaaaatctttctaaatagcaagacattatatattaccattgttaaaagataaacgaattgagaaatatcattagaattatatgcagcagataaaatggtcactttttcttttgagacggagtctcgctctgtcgccaggctggagcacagtggcatgatcttggctcattacaacctccaactccctggttcaagtgattcttctgcctcagcctcccgagtagctgggattacaggcacgtgccaccaccccagccaatttttgtatttttagcagagacggggtttcaccatgttgggcaggatggtcttgatctcctgaccttgtgatccacccgccttggcctcccaaagtgttgggattacaggcgtgagccactgcgcccagccaaaaggtcactttttaaacttaaaaattattaagaaaacagtgaaaacttaatgtttaaaagagtagaagatagggaaaattattacacagaaaaagataaacaacagagaaagataaataaattgccagtgaatatgtaaaaagttgctcagcaccagtggtagttcaaatccaaatagcactgagttagcatttgttaactaataaattggcaaaaattatattttgataaaacccagtgttgttgacatcccaagaaaaagggctatgctcacacagccttggagcatgtgcacattgatgatttttttggcataaaaattagtggtttctattaaaatcagcagtgtaattcacaatcgctaagacatggaatcaacctaggtgcccatcaactgtggattggataaagaaaatatggtacatatatgtcatggaatactttgcagccataaaaaagaataaaatcatgtcctttacagcaacatggatgcaactcgatgccattatgctaagcgaattaacacaggaatagaaaaccaaataccacatattctcacttataagcaggagctaaacattgagtacacgtggacacaaagatgggaacaatagaaactggggactactcgagggtagaaggagggagggggtaaaggttgaaaaacaactactatgcctagtacctgagtgatcggatcaatcatgccgcaaacctcagcattacacaacatacccatgtaacaaacctgcacatgtacccactgtatctaaaatcaaaagttgaaattataaaaaataaaaaaataaaatcaacaatgtatatttctctcacacagccatcacgatgatgtatttggaataatatatgcataaggatgttcattgcagtgttgtctgcaaggacaaagtgaaaacaatctgaataaccaacaatatgacacagagtaagtaattattggtacgtctgtacaatgcctcatgcaatcaccactgacagcatgggaaagagagacatctattatgaaaagaccactaagacatatgattacatgataagtgcaaggttcatgaataaatagtatgtatactagtatagcatacttctttctaagaaagaaactataacacatacaagaatggacaagaagttattaacaatagctaactttggtgataagactgtaggttgtaaaaagccagactttcatttctcattttaaacccaatgaattatttaaatctaaccctactgcattcattatctttacaataaaataaatatgtataacaatgaaacatagtttttaagtatttgggacataaattaaacattaatagattacacctcttaaacttggtactttagtatcccatttctctgtgagaactctgaaagcttcatcttccacagtttaggtaattctttggtgtcttattttgttattttcttgccctgagattagcaatgtcagatctccaaactgctaactcttctctttggcagatcaaatgcttcttcttaaaaaaattaagtttttggtgtcgggagcgcgcggcgccccggctcccgcccgctcccagccgggcccctcagcggtcggcgggacggctcccggctgcagtctgcccgcccgccccgcgcgggggccgagtcgcgaagcgcgcctgcgacccggcgtccgggcgcgctggagaggacgcgaggagccatgaggcgccagcctgcgaaggtggcggcgctgctgctcgggctgctcttggagtgcacagaagccaaaaagcattgctggtatttcgaaggactctatccaacctattatatatgccgctcctacgaggactgctgtggctccaggtgctgtgtgcgggccctctccatacagtggctgtggtacttctggttccttctgatgatgggcgtgcttttctgctgcggagccggcttcttcatccggaggcgcatgtaccccccgccgctgatcgaggagccagccttcaatgtgtcctacaccaggcagcccccaaatcccggcccaggagcccagcagccggggccaccctattacaccgacccaggaggaccggggatgaaccctgtcgggaattccatggcaatggctttccaggtcccacccaactcaccccaggggagtgtggcctgcccgccccctccagcctactgcaacacgcctccgcccccgtacgaacaggtagtgaaggccaagtagtggggtgcccacgtgcaagaggagagacaggagagggcctttccctggcctttctgtcttcgttgatgttcacttccaggaacggtctcgtgggctgctaagggcagttcctctgatatcctcacagcaagcacagctctctttcaggctttccatggagtacaatatatgaactcacactttgtctcctctgttgcttctgtttctgacgcagtctgtgctctcacatggtagtgtggtgacagtccccgagggctgacgtccttacggtggcgtgaccagatctacaggagagagactgagaggaagaaggcagtgctggaggtgcaggtggcatgtagaggggccaggccgagcatcccaggcaagcatccttctgcccgggtattaataggaagccccacgccgggcggctcagccgatgaagcagcagccgactgagctgagcccagcaggtcatctgctccagcctgtcctctcgtcagccttcctcttccagaagctgttggagagacattcaggagagagcaagccccttgtcatgtttctgtctctgttcatatcctaaagatagacttctcctgcaccgccagggaagggtagcacgtgcagctctcaccgcaggatggggcctagaatcaggcttgccttggaggcctgacagtgatctgacatccactaagcaaatttatttaaattcatgggaaatcacttcctgccccaaactgagacattgcattttgtgagctcttggtctgatttggagaaaggactgttacccattttttggtgtgtttatggaagtgcatgtagagcatcctgccctttgaaatcagactgggtgtgtgtcttccctggacatcactgcctctccaggtcattctcaggcccgggggtctccttccctcaggcagctccagtggtgggttctgaagggtgctttcaaaacagggggcacatctggctgggaagtcacatggactcttccagggagagagaccagctgaggcgtctctctctgaggttgtgttgggtctaagcgggtgtgtgctgggctccaaggaggaggagcttgctgggaaaagacaggagaagtactgactcaactgcactgaccatgttgtcataattagaataaagaagaagtggttggaaatgcacattcctggataggaatcacagctcaccccaggatctcacaggtagtctcctgagtagttgacggctagcggggagctagttccgccgcatagttatagtgttgatgtgtgaacgctgacctgtcctgtgtgctaagagctatgcagcttagctgaggcgcctagattactagatgtgctgtatcacggggaatgaggtgggggtgcttattttttaatgaactaatcagagactcttgagaaattgttactcattgaactggagcatcaagacatctcatggaaatggatacggagtgatttggtgtccatgcttttcactctgaggacatttaatcggagaacctcctggggaattttgtgggagacacttgggaacaaaacagacaccctgggaatgcagttgcaagcacagatgctgccaccagtgtctctgaccaccctggtgtgactgctgactgccagcgtggtacctcccatgctgcaggcctccatctaaatgagacaacaaagcacaatgttcactgtttacaaccaagacaactgcgtgggtccaaacactcctcttcctccaggtcatttgttttgcatttttaatgtctttattttttgtaatgaaaaagcacactaagctgcccctggaatcgggtgcagctgaataggcacccaaaagtccgtgactaaatttcgtttgtctttttgatagcaaataatgttaagagacagtgatggctagggctcaacaattttgtattcccatgtttgtgtgagacagagtttgttttcccttgaacttggttagaattgtgctactgtgaacgctgatcctgcatatggaagtcccacttcggtgacatttcctggccattcttgtttccattgtgtggatggtgggttgtgcccacttcctggagtgagacagctcctggtgtgtagaattcccggagcgtctgtggttcagagtaaacttgaagcagatctctgcatgcttttcctctgcaacaattggctcatttctcttttttgttctcttttgataggatcctgtttcctatgtgtgcaaaataaaaataaatttgggcaaaaaaaaaaaaaaattaagtttttaaaatgtatttcataggatttttgttctctctctccctctttttgtgcatatgtgtgtgtgtctgattagtctttactatcttaaaatggttagtcctgatagacctgtttcttcaaaatttctctcagttctttggcagtttgctcttagcttataattaaagatcaatttctgacttgtcttgttctagaaaacctcaatggaaattacagcaagctgaataggatattaattaaaaacataaacctggtgaaacccgaacatagaggctccagttcaaagatgcttccaatagttgacatggcccttcattccttaaaaccagctatttttcttttgaattacattacctttaattctgtaaattggatgttatatagtaccatgaaaactgctgtgagtaattataatactcattgctgagtgatgtgacttctttctcaaggctatttctgagggaaattgtacaattagatctttaggtattgtgacttgttttggaaatcatggtggccctccagggagctaatgaatctttaattatttagaggttcacatgagaccccttacagatataagcacattagctctgtagctaagggaacatttaaaaacagtaacatgaaatgtgtcagacatagaggaaagatgaagaagcaagtagaagctaatgcaaacagaggaactgccagctctctgtggcactctagctctctctgtcagtatttggttggcaatgtagacatagtggatgagtgcaattacatatgttaggctcattctgaaatgcaggagcattttagattttcatgtagaagcctgacaagcaaactacatctaggatatactttgataactttgagttgagagccaaattttttgaaggtaaaccatctccctgttttaaagtagtgtttaaaattataaaaattttaatacatctgtaatataaaatatttagatataaatactacaagtgcaaatgaatttttttttctacttctgcattcaacttttctcttctcccttcagggaaaacacttttgtgtaaaggcctccaaaatatatgtagaggtgtatgtatgttaaaaacatgtatacatataatgcataaccaaacaaatgaaatatcctaaacatatggacctgaaaattgcttataataaatttgaactgaacatataggcataaatgtggttcagaagtgtccagttgaagcaacttcactttgttaggtcaacaaaagttggggacaccaagatctactcctctgattttgttctagcattatcttaatggaaatgtttactgaaatggaaatacatgtagtggacatcgtggtggtgtctcaagcattcagtgttccctgctctcacacactcctaaccaaataatgaatttctcagcttcacaatgtttaagtgacatgagtcccatgcccaattcttggtcattgtaattggtgcatggaaggaacctgtgccttctgctaatcaaatcagaatgaagtacaactttttcattccatgattgaagagggaaatgccttctttccaaatgcagcagaggaagcatgaggtactaggattggaagttgtctactcatgacatgatattttaagccatagaataaaactgagacctaatgtgttagtcctttcaggtcgctataccagaatatcacagcctggatggtttatgaacaacataaatttatttcttacagttctagaggccaggaagtccaagatcaaggtgtcaacagattcagggtctaatgaggatttgtttcctggttcacagacagctgtctttttgctgtgtcctcacatggtggaaggggcaaggaagttctctaaggtctcttttataagggcactaatcccattcatgagggctctgtcctcatgacctaatcaccccccgaagacccactgccaaatatcatcacactagggattagatttaaacatacaaattttgggggggatacaaacattcaatctatatcacttaaggtagagtgaagaaacagggaggacaagaagcatttattttgtgtcattattaaacttctgcattaggctatcttgagcctatactattgttcaaaatctctttattatacaagccattttgaattttgattgtttgcaaccaaaattaacctaataagttaaaatgtactataatgttacatcataatttgtctgtactagtagtatttgctagagtgtttaggggaatacttgcttgttaactttttagtaaatataacactccatgttcaaatacatttgggaaatgctgagcatttcacacttttagagactcaaaacaggcagcacatttttaaaaaataaaaataaaaccaaatagcattgcatttggagaatggtacaaaaaaagagaatttgataaaccagagttatcagaactcagtggatactatgtgttagacattattataagccattaaacattttacaagcttgatacctgagttaaaaattaataacccaaagacacattggaagagaaaagttgacatatttttattatattaatgacctaaagatatcatagcaactaacctcattatagtcaacaagtgaatgaacgtaaataatattaaataactattggaaagtctctctgattaagcatggaaataaataggcagtgcttttgaccaataaatggaggacttacaatattttccaatacgaaacaaaaagattctaaatgtaaaggttttaggcccaaaatatgttagtcaattcatgacagcagaaattcagcaggtcatatttttggggtaatgtaaatgacaatagaaatcatggactaaagtgtaacaaataagtaatatctaggcaggtggaaattttaagatcttttaaattaacttctggactatagcaaaaattcaaactaaaattcatcagggagtcagggaaggtcaaatgaagaagcatggggattgaggcaaaaaccctgaattataccaatattatctttttttttattatttttattttgagagaggatcttgctctgttacccaggctggagtgcagtggtgcaatcatagttcactgcaaccgcgacctcctaggctcaagagatcctcccacctcagcctcttgagtatctgggactacagaccctcatcaccacaacacccgtctaatttatctattttttgtaaagatgaggtctcactttgttgctcaggctgacaagtattatcttaatgttatagaagaaaagtaattctggccatatataggtattattctttgcagtggaatatcatttcagaaatttgtgccaaacataaaattagttttctagtagtaaaaagtaattaaactctttaaattattattacccctagtatactggggaatgagtgtgtgttccaaatgaaaaaaacttgggatgtctaatgagatgctgttttctgtcgcagaaaatctatgtaaaatgttttttctcacgtgtacactgttgatatttgagacagcacatgttaacacttcaagaagtaaaataaatgtgttgattatatccacagttttcatatttattaactatatattttgtttttaatgtaatgcctattgaaaaacctgtaaatagttgtttcttaaaattgataaatactgcctaagatttttctgtatattttcatatttcaattttcctgtgaggttagaatgaacacttttagctaagacatttgggcctccaaatcctaaacctttcagaatgttagtttattatttggtttttacctaaattattttctgcttattcaagatccttaggtctatccagttacgtttttatttttttatttttatttttttattttgaaacaaagtctcactctgttgccaaagctggagtgcattggcatgatctgggctcactgcaacctctgcctcccaggttcaagtgattctcctgcctcaacctcccgagtagctgggattacaggggcataccaccacacccagctaatttttgcatttttagtagagatggggtttcaccatgctggccaggctggtctcaaactcctgacttcaggtgatctgcccacctcaggatcccaaagtgctgggattataggcgtgagccaccatgcctggctgtatccagttacatttttaagaccagccaggcttaatatatatttggtctttagctcaattcaatttgttgcattttgtccattgtacttcatgtgacacagaatatatcttaatttaaaaagacatatgtttgttgagctatctgttacgttggtatatcttggaattttaaaaaatataaaccacagaagccaattatggctgacattaacaataaataggtttatcacagaaatagtggggaacttgtagaactgttgagaaggctagagagccagatcaaagctaggcagccaggaaatgtaccccaaaccatgctgtagaactcatccagggaggaaaccactgtcaccaccagtaagaagtaacaccgaagatgcagagagcaacaattgcagcaattgctcaatcctaggctaactgcaaagccaccagcaccactcccacttgttcgctttgcaacagatagctgcaaaggaggctgagaaagcaagcatttgacattttagcttctaaagcaggaggtggtttcttgttttcgtcaaaactgagaggctgaggaattcctcaaacacaggaacaaacatcaaatagtaaatattcatgctttaacttgctcaatatcaatataaactttcccttttgaaagtaaacacgaaagacccaagcttccttctaacagagtgcaactatttctctaataattgaacatgtacctacaatctcttgaacaatgaaacaataaaaaattctcaatcacagcatgtactctaagtctaagaattctgggttatgtccattcctctacaaagttcttcactatactctcttgacattctgccatatatcatttaaaaattaagttaatcaccctcaataagccctgttttaaaaagagggataaatggagaggaaagaaggaaagttgttaagatacataagtatgcacaggacaatacaagagaaacaatgtgtttggatgtaaaggctctcctttctgcaagtggccagcaggtcactattggcatctatggccatgtgccctcagctaacacctctgctagtcagggttttgccttgtgaaatgaccaaatattcattcctgacagagaaatgtccttgataatctttttgtgtgagcgtgccatggtcattgttaatttctttcatttaacaaaataatagactttattttttgagcagttttagctttatggaaagatcgagcagaaagtacagagttctcacatactgtcacctttatcccacccccagtttacattagagttcactctttgtgtggtacaggtctaggagttttgcaaaacgcataatgtcatgtacccatcattacattattaccaacgtattttcaatcccctaaaaatcgcctgtttcagaactatttatctccctacccatccccaaactcctggcaaccactgagcttttttgttgttgttgttgttacttagtttttatttcataatcataaacttaactcaactctgcaatccagctaggcatggaagggaacaaggaaaacatggaacccaaagggaactgcagcaagagcacaaagattctaggatattgcaagcaaatgtggtggaggggtgctctcctgagctacagaaggaatgggtctggtggtgaaaataaaacacaagtcaaactcattagaattgtccacagtcagcaatggtgatcttcttgctggtcttgctattcctgtacccaaagtgctccgtggcttccacaatattcacacgttctttcaccttgccaaacgccacatgcttgccatccaaccactcagtcttggcagcgcagatgaaaaactgggaaccatttgtgttgggtccagcatttgccatggacaagatgccagaacctgtatgctttcggatgaggttctcatcatcaaatttctccccatagatggacttgtcaccggtgccattagggcgtgtgaagtcaccaccctgacacataaaccctggaataattctgtgaaagcaggaacccttataacgaaatcctttctctccagtgctcagagcacgaaagttttctgctgtctttggaatcttgtctgcaaacagtttgatggagatgcggcccaagggcttgccatccctggtgatttcaaaaaagacgacggagttgaccatggctgatagtacagggctcacagcgatggtggcgtctgcaaagataaccactgatcttttcactgtctttatagtttggccttttccagagtgttgtatagttgaaatcacagtatgtacccttttcagactggcttctttcacttagcaaaatgtctttgtttttctgtatctttttgtggcttgatagttttttccttttagcactgaataatattccactgtaggaatataccacattttgcttatgcagtcacctattgaaggacatcttggttgcttccaagttgtggcagtcttcatttctttctttctttctttctttctttctttctttctttctttctttctttctttctttcttcttctttttttttttttttttttgagacagagtcttgctctgtcacccaggctggagtgaagtggcacaatctcagctcattgcaacctccgcctcccaggttcaagtgattctcttcctcagcctctggagtagctgggattacaggtgtgcaccaccacgcctggttagtcttcaggaatatttacaggactgtatagaattaggagccatcaaaggggatccctgaattctttctgtttttcttacaaataccagttttaaggtcaagatttactaccccatgccacagtgtagccgcattttaaattttaaatttttgactgtttgtttaaaggtctcaggcaacctaaaaggctagatagaagtctctcatcctctaacgaaggatggattgtaaaatggaatactgctaagactctccctttgggtactaattctgcaaaaacctagaatctcagagacaagagacaagtatttggagtggatcattagatgtaatgacaaaaggagtcacttcaacattcataacaaatatcaaagattgttgtattttttatataggagacaccagacaagcttatacttagttactagttcagaggatacaccaccacatcctctagcatgagtacaaccttataagccattgtctccagctggcactgtgattgagtctttaataaaatattcaccattctgtaataataataattttggttagtgataggataaatggtggaccaggtgagtccaatgaatatctactcatttgttatacaacaagttcttttaagagaaggatgtagaacaggatattatggcagtatatataaggcattcaatgtacccgtggagagtggcgatcagagaaaaatgatgtcaggtaaagcaaatgtaattcaaggttaaaggtagattccatttacaaaattccttgttgcctttatcatagaggagttccaataaaatcaacaagtctgacaaaaggtgactggtttattcacccaggatatgttattgtgtgcttagccttggactttgttgcttgtgtgttggacacctaatagtcttgacagctaaataggcttttgtaagcgagagtggtaaagtccaacatgttgctgaacctatgtgtattctctactgctaccaccaatgttgctgtttattagccttctaagcaagcaatgtagtgcctggtgaaagagattgtttcataccttcatatctatttgataaccttcctgatgatagtttggtgagcattcgtattaagcacaaatattcttacactctggctcattttctgtggttcatctacatattttttccccaaaactcattgccaccaatccttcagtctttgtctttccgagtccctaattatcttttcttttctttttttttttttttttttgagacagagtttcgctttgttgcccaggctggagtgcagtggtgcaatcttggttcactgcaacttcttcctcctggattcaagagattctcctgcctcagcctcccaagtagctaggattgcaggcacacaccaccacatctggctaatttttgtatttttagtagagacggagtttcaccatgtcagccaggctggtttcgaactcctgacctcagacaatccacctgtcctgtcctccaaaagttctgggattacaggtgtgagccatcaggcctggccccaagtccctaattatctagacaaattattagctgccacatatacatcaataatatctctccttctagacatcgtggacaaccaattacataggctgaatttcttttaaaattgcattcacgtaggttataatgcctaagcaatctacttttggctgctgctgtgatgttgtacagtgacttctgtaaatcaggctcaatttttccctcactaatcaactggccatagagaacttcccatgaagacataggtatagattctattattcctacctgctgatgaagcaggatagttaattggaaaacacttatttcatgataagcagctcatgttgtcatatttttttgcattgataggacttcagtttctacaatggtccaggatcaatcaagagttctttaaagaaaacatttattttgtcaaagaaatgcattttgttccaaatcctaagaacaatagtagtggtgtgtcagaggctctattgcatctggatataaaaacaaaggggcacaatattcctgaccagttgggaattattatcttcatctcaatcccatcaaaatgtggcagcatgacaagtcatgaagtaaaaggaccaggtgataaaatgaggtctccaaaatccaaagcatcaaagttctcagttagtggtcagggctgcaaagtgccataattttgcactttggaaggtatatcttgagaatattgagtgtatgagacaagttaaaaggtcatgcagccagacgcggtggctcacgcctgtaatcccagcacttagggaagctgaggtgggcggatcatgagatcaggagttcaagaccagcctggccaatatggtgaaaccacatctctactaaaaatacaaaaattagtggggcatcgtggtgccctcctgcagtcccagctacttgggaggctgaggcagcagaatcgcttgaaccctgaaggcgaaggttgcagtgagctgagttggcgtgactgcatccagccttggcaacactgcgagactctgtctcttaaaaaaactaaaaaaataaaaataaaaaaaatttaaaagttcgtgattaacacctctgttagcctctgatctttataataattatcacacacacacaaaccaaacaccacacatagaggaaacagtaaaagattaaaggacacagctaaaaatacatttgtattattacttcccaaagttctaaaattatcagaagggactagtgaatctttaaaaaatattgattatccaacactttttaataaccagtataattgcattgaaggctactgaacatgcacatgttcctaaaatttttctgttatggtgtctggtttgcgaaaggaacaaaattaaacatagttccttggcaatttttccctcttccactctactaattggcgtatgtgcgatgtgtgtttattgtaaaataggaataagattcagaggtcaagaatcaaagtgagtcagagtaggaaaagccagactcaagcataacagaagggcagagcctgtcaaaccccaaaattaaagggtaaatttcaacacaagtagaagtggttcaaaagctaagggcatcctcatagttcatgaaaaacaagtattcacgcaggtagcagactctaatctgcttcaagccaatgtgctattctcttcgtgttatttatatccctcagaatacctcaaagttcccaagagcagtcagtatttaactctaaactatatcatctatatgatatatttattatatataatatatatatttattatttgtataatacatattatatatttattatatattatatttatattgattatatataatatatatatatttattattatatatttttttgagacggagttttgcttttgttgcccaggctggagtgcaatggcgctatctcggctcaccacaacctctgcctcccaggttcaagtgattctcctgcctcagcgtcctgagtagctgggattacaggcatgtgccaccacgcctggttaattttgtatttttaatagagaaggggtttctccatgttagtcaggctggtattgaactcccatcctcaggtgatctgcctgcctcggcctcccaaagtgctgggattataggtgtgagccaacgtgcccagccaactatgtaatattttaattgtgtagtgataaccctcatcaaaagaagtattcattatggtcagtgtactctgcttatttaccactgaagcttaacacaaaattgttgaaataaacatgcatattgaagtacttagctagctattgaggcaatacaggtttctagatttactcatttttttcactgtacacacatgtcgtgtgtgtcatgataaacccatgtgtgtgcatatattgattaaatattatatttctttttacttttattattattattgagaaaagatctcactctgtcgcccaggctggagtgcagcggcacaatctcggctgcctgcagccttgtcctcccaaagccctagaccctgtaacataatggaatatgtatgtttctaatttgtgcaatatggaagcaggaatactacatagaactgtcatcttttcctattgcatttattttggtgtggaaaaatataataattggcttcagtcagtaagtctatttcattcaagaatatttaaatataatccaaaccatcttaggtacattttgtgatacaagaggatggtatcttctatttggaaatataaaatcccagggtctcacagtttaagtatactttccatgggtatgtataaaacaagaatcccactttacaaagttaatagaaaaaatatatgctaattggaaggagaggcttctgattgaggataaagtggaaattttcacatactgctaattacactttaatggagtaagaaaaaaagaattggaaatagtaccctataaaacttctgaaatgaaattacagtttctctctctctcttttttttttttttttcttgagacggagtttcgctcttgttgcccaggcgagagtgcaatggcgctatctcagcacactgcaaccttcacctcccgggtttaagtgattcttttgcctcagcctcccaagtagctgggattacaggcatgcaccaccatgcccagctaattttttgtatttttagtgacccaccacgcctggctgtctcctctttttagaattaggagaactgatttttttcagtgctaaactggcactgtcctatgttttcaagaaagcaatatggtgaaacgaaagagcctggatagcatgttttgttagctggcgtctagttctttaagttccatgagtctattgtgtcttctttacatctcaaaaagaagagagaagaaacctgcatctaattactgaagcagtttcattcagcaaatgtaattgcatcgcaggcacatctcaaattaaaaatcttcatcttggtctctgtcatttccattttaaactgggactgaataacctgttttaccactcaaaataatagccagtgtctctttcttattaaaatatgtgatcttttgcttgattacctaattatgtcacctgcaccttacatgaggcagatagaagagtcttccagtctgccagagcagatctaccaaactagactgcacatacaaattacctggggatcctgataaattacagattctgagtctgctttcaaacagggcctcaagtcaagctgatggtattagtcccaggatccctcactgagtagcaaggtcttacaattaaaaagtgtgcaagtataaggccgggagcagtggctcatgcctgtaatcccagcactttgggaggccaaggcgggtggatcacctgaggtcaggagttcgagaccagcctggccaacatggtgaaaccccgtctctactaaaaatacaaaaaaattagccaggtgtggtggcacgcacctgtaatcccagctactcagaaggctgaggcagaagaattgcttgaacctgggaggtggaggttgcagtgagtcaagatcacgccactacactccagcctgggctccagcctgggcaacaacagcaaaactccataaaaaaaaaaaaaaagtgcaagtttataaacatggaaacgtggacaattgtaagcaatattagagaactgtagaaaacaattttttaagtgatatgtttaacctatttagaataaaacccattatggtcctaggaatttctggaactgccttacttgtgagaaacatgatcctaagatgcccatttgtttatcagtacatcaattttctccttcttgaattggtatcattattttcttccaagaagcctagcacacttttgttgttgtcattgaaagagggcatataagggttatggctgctatttggagaaatgcattagaaaataaaaagcttgaaaaagttgtattactgagaaaaaagttgaatgaaaataagaaagattaaattgaaataaataatgaatcagtaaggtatgcactgttaaacacttgatgggatttcccaagtatcgacatgctgataacttgaaataagaatgggagaaaaggtcaatctgaattcttaaaatgttgaaggctgggaataagaagtaatatatcacagaatctgatagaaaaatttttatttattttatgggagaaatgggagactaacagacaataggaataggaaagaattaatagaaatagcaaaaagaagtgtatctgcaattattaatataatacaagaggacattgtgtagagatatttaaagaaagattgatgaaatttagatttatggagaaatatcctaataaagacattatttataatcaactgttcatcattattatataattctgacagtttttaggttataaatgtaaggcagaatgatctaatataaaatgtataaatgggacaacatataattttgcttaggaagttgaataaataaagtagtgatttacaatttgcattaatataaaaaaatttaaaaaatggtttacattttgtttgaaatggatgataaacaggaaaagagtaatttagtacattgagtaatttagtacattggtcaccaaagaaatacaaattgaaactataagatgccttctcccatctttgtcagatttgtaggtataaaaacagtagtagttgtattcgttggagaacagaaagatgacactttcatatgcggctgattagagcacagattggtatattatttctgagatgcaatttgaaaatatgtaccatcagcctcaaagatgattatgaccatgtgtcactactttcttggaaatcattattaatgcatgtatagattgatgtttactgtagtattacttaacataatgagttgagtacaaccttcactcccaaaaaacatgaggtaggggtgaactagttaaatatacaatcacaatgagctatgacaaaatgcagttacttaaaagcacatttataaaactattaatggcaataaacatgatttaatataatgttttcaaaaattaggggaattctattcccagcattgtggtagactaaatttgctgaatcactatgctgctatatgaaatctacaaataccagataaaatgtacatgtcatttttcaaaagtatattactgacttgaatagaaactaaggtgaaccacataggccaagcataaggagaatacataaatccagagaggtatgcagacccccaaaccagaagcttccataaggacagtcctggtcctagtaccctgagcttcaatttttatgaccacctgggatatgggagagtgtgagacaaaacctagtgcctgcccagtatagcagtcttacaggagaaaactgctgaaagccacagatacgaaggactataatttcagggaaaggataaactagataaaaacctgttcctcagggggagacaaccaggaaattttcctgcctcaaactcggtgctatttagaggaaaaatgagaaggccatcttcacatgaatttgtggtttaaattttcactgtaagtataagttaaaaaaaacccacacatgaaactgataatttattttatagttatcccatgttggtattaccaccaaacacaagacgaaggcaaagtgtctttggagaaacccacattcagcccatgtctcaaagaatggccacaggtaaaatttcatccaaaatgagaaaaaagtaagactcttacaaaactcatgaggaaataaacatcatgagcagaaacagaattatgcccataaagatttcagatattaggacgattatataactataaaagctgtgtttaatatgtttaaaaaatcaatgaggtgtgccaggaatataaattgagacagtgtatgtatcttatattaagcagattgaaactgaatttaagagatcttttagaaataaaaaatataatgaaaattaaaaactaaatggacaggttaaacacaatattggatagaaccaaaaagaaaataagtgagttggaagttagactaaacaaattatgctgaagacagtacagaggaggaaaggaaaatggatatgtgaaatagaggttgaaaaattagagtatctaatcatatctgcaaaagaaaaattgaattgagggaaggttatatttaaggttatatttaatatctgagggcttttcgtcattggaatttattaatgttcaaggaaacctggaaagttttctaacacattaaaggagctttaattataagttccaaattcttcttagaagaagagaaccagcaggcccagacatttttactggtgagttctatcaaatgttttcaagaaatggattatttccattttataaaaacaactccagaataaaaaaaggtccatttgttcgttcattttatgaggccagtacaaccttgataccaatgttatatgagaaatgtgtaagacaggaaaattacatgccaactttcctcatgaacctaacggcaaacattttaaattaaaagttagcaaattaagtttagaagtctataaaaaatatagtatgaaaattgtgtttgttccatgaatgcaaggatttctaacaatagaaaaaaaaaactatgtataattcatcacattaacaagttaaaggaggaaaagcaaatcatcattgtaggagaggcaaaaagtgaattcaataaaataaaatatttaactttgacaaatcttgtttagcaaacaagaaatagaagagctttcagtgtttgcttataaatcagaaactattcttcgtctttcaagcagaggtgatttaatacaggtgattgattacacaagtgatggaagccaaaccaggcttggtgagtcagcagcccatatttaatatatttatatattaaatatttaattatacttcaaaacttttatgtacactataatctcattattgttttctatactattatatgcaatatacaaatacagaaatacagaaatgtacctcagtttgaaagagaatttgaatatgaggcaaaaagatacccccaaattatagttacattacaagaattgaatttaagaaggaagaagcaaattgcaagagataaggccaagcctctttagtaatgatcattctaaatccaattggtataaatttaggaacgcacaactggattgcagtgtaactaagaaagtttgtgtgtcaataaccatatttatcctatgtgaagaaataatagtttcataggagaaggttaattggcatggagtctgtaaaagagaagtttggatagatgattgagctatgtatttgtcaaataatatctaaaggtaaaaagagatctagttcacagaggcgaatctctgattttttaatttgcattaacagaaacaacattggaagggagtatattaagattttaatagtgactatttctgccaatggtttctgttttattgtttactatttttggtatatttccaatgtttcttaataagtgtttattatttaaaaaatgagaaaacagcaatgagtaattcagtaaaataacatttttcaaaattgtgactgctatgattatgagccaattatgaaagaaagagacacagatagaaatagggtgaccaatctttcaacttactcaggaatgaaggattttctggatgggggatttttgttgctaaaatcgggacagtaggggacatattgggactgtggaaaaaccctacagggatttatttcctaactatgaatttctatcttggtctagagacgactgttctcataaataggtagaatagatgtggtatttctggaatgagatttaacatctttacgtagcttgccctattaaaagtagacaaatgcttgtgagagaatatcatatacttttgaaagctaatgtcttaactaattcgctgtgagcaaagctcttgaagactgtgatgtaacagagattcctaggtatcagtgaagatacggagatgaaaaagggaagttgaaaaaagaagctgagagataagcatggaaatcattttccaaactcatttttccaatctccattttcctgtattgagaagtgaaaatatgttttctagagataaagttctagaaatgaactctgacatagatattttaaaacccatttcagaaacaaaataatatgtgaacctagagtagttgtaatttatgtccttttgtctgtctttatcctgtagttaagtttcccttgggatctctttgggaaaatggagtactgcattttacaaggcaggacttgaattttcgttcttttccttctttctctctctctttctttctttccttttcttctttcttctttctctctttttctttctttcttcctttctttccttcctttttcttttctttctttctctctttctttcttcctctctctctttttctcttctttctttctttctttgttcctttcttctttctttcttcttttccttccttccttccttccttccttcctcttcttcctttctttctcctttcttttttttttttttttgacatgatctcactttgtcacccaggctagagtgcagtgatgtgatcatagcttaatgcagcctctctctcctgggctcaagcaaacctcccacctcagcttccagagtacctggggctacagctgcgtgccaccatgcccagctaaaggacttgaattttcttacatatcttggccctatagagtggttctcaacctcggctgcacatgtctattacctgagaaaagttttaaataacctaatactcaggtcacaccctagactttaggggtgagacaagcattaatatttttttaacactcttagaattaagagccactaatattgtagcactgcaattcctataaagagaacagatgtgagtcgatttgttacagtattgttgtattcatctgttttcatgctgctgataaagacatacctgagaccaggcaatttacaaaagaaagaggtttaatggacttacagttccacatgggtggggaggcctcacaatcatggtggaggacaaagaggagcaagtcacatcttacatggatggcagcaggcaaagagacagcttgtgcagggaaactcccattttaaaaatgatcagatctcatgagacttactcactaacacaagaacagcacaggaaagacccatcctcatgattcagttatctcccactgggcccctcccacaacatgtgggaattatgggagctacaagatgagattgggtgtggacacagccaaaccatatcaattgtcatcactcaaggcagatgagtatatagaaagctatcagttgtaaggaattggactaagtttaagagaataataattaagatagaacaaatgtttggtcctgcttaagggctaggatagatgaggcacaatagaatcatgtggggagctgtaaaaatgcccaggccctactctgtgtcaattaaatcagaatccagaatctctgcttgagtgtgtctagagtattggtcaaaggaaacagtgattttgatgtgcagccagttaagagctgatatcctcaaggatcatgatgtgacacagctgtttcagaagggtaaatctccatactcccactttagaagaaaagaaaaggcaaaatgacaaaacaatcaagcaaaagggctggaagagctggtagataacagggtgtcaacttgaattaattcagctctttggtaaagattagctggagtaaagaaattccagttagtcaaatgggatgaatgtccttttatggaaaccatatcatgctttttgaatgatctgagaaagactggaagcattagaggtgaagtatatccatttgctcaatgggagaagattttgttttattttatttacataatgtgatatgcttggccatctgcagtagtgcctgaaaggggatgtaaaacggaaaatgtagtcagtgagactgattaataaccatgggtagaaaaataggccaagtggaaaaacttattcatataattgcttcattttgctgactgcaaaaggatttgttttggaagtgatttctgctctttaacctagtggattgatagatcacagaaaggtcttagaaatgacattacgtaattttgttcataacatgaaattagcttgaatcaaaaaatgtatacctttttttgtatctaccttctaagacatttgtcttgagaaattaatgattctacaacataaatagtcattgtgaaaggaaggaaaaagataacagagggctttcataataatcatggactcaagattatctaatttaaaaagacatatctcattttcctttatttaaacataaaacaaatgagagaaaacagaaatagctcataattttatttgtctgataaaacatgctgacataaaaatataattcatgcacccagtaagaaaatcaaaaaattaaataaaggtaaaaatgaaatataaaattctctttcctctagtctcttacccccagacatctagaatctctccttaagataatcactgttgacaatttcttgagtatctttttaaaaatgaccttaatacacatcccccatatagaatatagctcttaaacaagttagaaaataaaattttatcttttagtattacacaaaaggatgttcagaactaggctttgtattttttttttctagagatgaggtctcaccgtgttgcccaggttggtctcaaactcctgggctcaagcaatcctcccgcctcagtctccaaaagtgttgtgattacaagcatgagatgaagtcttgcctggcctaggctttctatttttgtttaataatttaccttcaagatattcttaacttttaacaactgtattgtataaatatattttttatttaaacaataggctaccaataacattaataacatatcttggtttatgtattttacaagattctccatgtgataaattccaacctgagaagttgctatagaacatatgaatttaacattttttaattgctgtgatctaatatgatcctaaaacatggccctagtttatattcctatgagaatgtctaatacctacactcttgctaacattgactgctattgcattttaaagactcaataatttggttggattgatgttgaacatcttctgttattcctggccattgcatttctttttctacctattaatctcccttgtataatattgcattatttgtcttttttgtctcatttatcgacaaagattaaagttattggcagtagtgaaaatggagaaaaaaatcaaaattcaaatactgtagagtacaatattttggagaataatttgattctatatattgaaatttaaattgtctttaatctttgacccagttattctatttctagtaatttttctacccaaataataattcaggaagaaaacctttacagagattattcttataatgtttgtgatacaatatttacgggcaacataaattctcatccagagattggagtaaatattatatagtatatctgtagaatgaaatgtaccttgctgtttaaatgaataaattagttattatcataaaataaatgtcatgtaaagacatttattttatggtgtataaaattagaaaaacaagttattaacaaaacatgattttttgtaaaatgcttttattttgtttttaattgacataataattgcacatgtttatggggtacagtgtggtgctttagtgcatgtgtacattgtgtaatggtcaaatttaaaaattacatgtattgacagaaaaagtgtttggatatttgtatcctaaatgctaacagtgatgatatctggaatgtggaactgctggtaatttttccctttttcttttagagatttttgtacttatttttaataataaacatatactaattttataataaaaataacaatgaagtcctttccattttgaaaaattaattccaatagaaaaatactgtactcgagccactttccagggttttcttattcttagtgctggtataaggtaccagtgatattatattttcagatatgtttggcttttctgccttatggttgaagatgagcttaggaagtattgctgcctaattttcaggcttttgagccaatgcttggtgcacaaaaagcaccacatcaactttaaacagaatattctgcttctttagactgtatttcctactttttatagtatttattagcgccagaactctgtgactgtttgtttcccaaagaacaagagagaaagatcaaggaaattgagaagcaatgaaactagatttaattaatactctggcttgtcagcagctttcatgaaagatttgtttgttgaagaagttgaacctattagcttaaacagggattaactctgccaactctgacagagcatggacaattaagagtttattggaaattaattgaaaataatacagtgttgtgaggtgggatgaagatgatttcctttaaggaaattatgccaagtgttttgaatcagccaaggataaacaaatgcagactatcatttgatggaggtattataaactgataacatgattcgaagtataagaatggcaaattgtgaagaatgaataaaattacagagataaatagcaaaaatgtgaaactaaaataaagaggaacagtgagtaaatggggttagctgagaatatggtttaacagggcatactctattcatttatgaagaaattttaatcctcaaaatgctacttgtcttagtctgtgtaggctgctgtaacaaaataccacaagctgagtaacttataaacaacagaaatttcttacagttgtgcaggctgggaagtccaatattaaggcagattcagcatctggggtgaggttcacccttctggctcatagatggcaacttcctgctgtatccccatactttggaaggggccaatgagctctctgggatctcttttataagggcacaaatcccattcatgagaatcttgtcctcatgacctaatcacctccccaaggctctatctcctaacacgagtagcttgggggttaggatttcaatatacaaatttggggggacataaacagtcagtctgtgacattgccatttcatcagtaagaattttcatgaactcactattaagatttatgtttaggttttttatgcggatgttctcactttataatattgtttgtctgcatagtttaaagaaaaggacaatgcccaattagaacaggaggtgtcttttgttggccagcaaaatattttaagatgccttgagtgtgaccctacatagagatcatcaaggtaacatcattttgttcttgttctagatccacatgtttcactcaagatcccagaaagaaaatgtatgaaaacacattggaagacaataatccatccttacaatgctagccaatgtttattattgctttctatgtgtgaggaattgtgttaaacacttaaaaagatgttatccctcataattatcataacacctgaagaagtaggtggggtgattttctccaatttagatattataggaactgaaacacttgcccactaaacaggcaattgaaagagataggatttctatagaaaattgccagctccacagctagtgttcctattctcatcattagtgttcccttagtggttttgatattacacctaatactatttaatacaaaattaaagcatccaccctattctgggatttactgtcaagaatagagcactgagcctgataaacagtatccactttggaatgcatgtttctatccagctacttaatatgacataagttcattggacattaaggccagatttcttgacatgctttaccctcaaattaacaagtttggcttattcaattatggacctttaacccttaggccagatagtatatgaggcctagagtagtggaaaaaggtaactggatttacaaaatatgactcttcaaattctgtaagaattcaatatattgaggaacgtttaggtgcatagtaaaattataatttcatattgttgcacagactcaggcagatgaaagagactccaatagtggtcaggtagtacccagacagtcagttgattgtctctgtgctgaaaggatttaaagatgaagaagagtttgctccaatgtatgtttcaatatctcattgttttacaataatatttgaaataatacctaggaacccaacttacaagggatgtgaaggacctattcaaggagaactacaaaccactgctcaaggaaataaaagaggacacaaacaaatggaagaacattccatgctcatggataggaagaatcaatatcgtgaaaatggccatactgcccaaggtaatttatagattcaatgccatccacatcaagctaccaatgactttctttacagaattggaaaaaaactactttaaagttcatacggaaacaaaaaagagcccgcattgccaagtcaatcctaagtgaaaagaacaaagctggaggcatcacgctacctgacttcaaactagactacgaggctacagtaaccaaaacagcatggtagttgtaccaaaacagagatatagaccaatggaacagaacagagccctcagaaataacaccacacatctacaaccatctgatctttgacaaacctgacaaaagcaagaaatggggaaaggaatccctctttaataaatggtgctgggaaaactggctagccatatgtagagagctgaaactgggtcccttccttacaccttatacaaaaattaattcaagatggattaaagacttacatgttcgacctaaaaccataaaaaccctagaagaaaacctaggcaataccattcaggacacaggcatggcaaggacttcatgtctaaaacactgaaagcaatggcaataaaagccaaaattgacaaatgggatctaattaaactaaagagctcctacacagcaaaagaaactgccatcagcgtgaacaggcagcctacagaatgggagaacatttttgcaatctactcatctgacaaagggctaatatccagaatctacaatgaactcaaacaaatttacaagaaaaaacaaacaaccccaacaacaagtgggcgaagtatatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacactttcacactgttggtgggactgtaaactggttaaatcattgtggaagacagtgtggtgattcctcaaggatctagaactagaaataccatttgacctagccatcccattactgggtatatacccaaaggattataaatcatgctgctataaagacacacgcacacgtatgtttattgcggcactattcacaatagcaaagacttggaaccaacccaaatgtccatcagtgatagactggattaagaaaatgtgacacatatacaccatggaatactatgcagccataaaaaaggatgagttcatgtcctttgtagggacatggatgaagctggaaaccatcattctcggcaaactatcacaaggacaaaaaaccaaacaccacatgttctcactcacaggtgggaattgaacaatgagaacacatggatacaggaaagggaacatcacacactggggcctgctctgtggtggggggctgggggagggatagcattaggagatatacctaatgtaaaagatgagttaatgggtgcagcacaccaacatggcacatgtatacatatgtaacaaacctgcacgttgtgcacatgtaccctagaacttaaagtataataaaaaaaattaaaatattctgcagtcacagtgactgtcttggcttctcttaatttatgaggacctttgtcttatagactcttttttttaaaaaaagatggggtcttgctatgttgtccatgctggagtgcagtggctattcacaggcttgatcattgcatactacagtctggaactcctggactcaagtctcccagtggctgggaatacaggtgagtgcctaccacacctagcctgatttacagatttttgacatctattatagttaaatgtattttcagcatttgcatattaaaggaataatattgatgcttaacttcattagtgatcagggaattccaaatttaaaaaaaattttttcatctcttatagtatatttaaaaattcattgctgataaggattcagggacgccaacattgtacattggtagtgaaaatgtaaattggaaactttctgtaatctgacagtaattatttttttaaaaatccttttgaacttgcagttctacttttgggatttgaatttatggaaagtaaagtgccagtgagaaagaatattgttgccccttgaacaacatagggttaggggagctggcctcccacacagtgaaaaatctgcatacaacttttgattccccccaaactactaataacctattgttgaccagaaggcttactgataacatgcgttacatttaagacatattttgcatgctatgtgtattatatactgtattcttacaataaactaagctacagaaaagaaattataatcaagaaaattgtaaggaagagaaaatatatgacccattcattaagtggaagtagatcatcttaaaggtcttcatcattgttgtgttcatgttgagtaggcagaggaggaggaggaggagctggtctttgtgtcttagggtagcagaggtggaagagggtgaagggatggaaggggaagcaaaagaggcaagcacacttggtgaaactttacaaaaatacatcattatttctgtctattttgctttttcatttctctaaaaacatttcagtgtagtacctatccgtcttccaccatttgctttagtttcagttcctgtatcatggaacggtctatgtcataaaagaagtcaaaagtagtcttgaataatcaaagcttttttgccagattgttgaatgccaatttgttttctggcactgcttttcctatgtcttcttcctcattatctggcactggttaggaagcactcatctccatgaagtcatcttttgttaattcctctggtgtggtgtgtattagctcttaaattcctccaagatccatatcttacaacccttcactccacacctttttttcccttcatatccatacttctttccatggttttctctaaattgggtttgtcgtaattctgtagctatgcacaacatctggacacaaattgtgcttttgtccagcaggaatttattgttttgagtttcatggttttctctatcaactgatgacatcttgaaaggtgtaagccttccagacttccatgatgttctctctattgggtttctcttttgcaatgttgacaaacctttccatagagtgccatatgtagagccttaaaggtccttatgactcccttatctagaggctgaagtagagatgtgtttgggggaaaaggagaacacttcagtgcctttggtgttgaactcatggggttctgggtggccagggggcattttccaattaaacaacaacaacaaaaaactttaaaaagcagtcccttactggcaaggtacttctgacttcagggacaaagcactgatggaactaatccagaaaaagcattctcatagtccaggccttcttgttgtacaaccaaaagactggcaactagtgtttctcttttccctttcaagactcaggggttagcagctttatagttaagggcagccctgatcataaacccgactacatttgcacaaagcagtagagttagcctatcccttcctgccttaaatcttggtgcttgcttctcttccttactaataaatgatctttgtggcttttatttttccccctggaatagggcactttcagctgcattaatacctattcaggcagatatcctttctcctcaatgtttttcttaacggcatttgagaattcacttgctggttcttggttggcagaagttgctactcccattatcctgacatttttaaaaccaaaccactttctaaaattatcaaatcatcctttgctgccattaaattctccagctttagatctttcaccttgcttttactttaagttgtcaaataatgacttcgctatttcttgaatcaaataagagtctataggtatgtctttcttatagcaattctgtaccccacataaaagctgcattttgaatatgagataagaaaggacaaggttttcatgcctgttggcacgaaatgaggccttatgaatttctctttttttttttaagggaccttacactggattcatttattttgaaatggcaggcagctgaagaactcaatctataggaagcaatctaactttttctcataatgtcacaacttttctctgcttcttgggagcactcccagcatcacttgtggcactttgtattggtctcatggtgttattcaagatttatagtattacactaagcacaatgaaaagagaactgtgagagaacacactatttacttagatacagaatttactgaagagaccaagtgctcatggcagatactggcaacatgagctctccacagtagcaacagggggtggctacaaaattattataatagtacatacactggaaagtagacgctggagaatattccaaaagatgccagggttggaggggagtgagggttgaaaaatgattattgggtacaatgttcactattggggtgatgagtacagtaaaacctcagacttcaccactagcaatatatccaaataacaaaacaatcatataataaaactatgcttgtacctagcacatttataaaaataaaataaaagtaattatttgggtagtacagtatgtgctatagttaattgtatgcagttgtggtttaatacagcatctttatgtttgtttatgtttctcttgactgcaaatagtgacttgtacggtttgtgtgcatacattttgataagttttaactttttataatagatttgtgtatattttatggtagtaaatgataaaatagattaatatatacatatactttatgcattcaggatgtacatagctttttcttaattttttttttatattctaggctatgcagttagtctgttagttttttcaattgcaattctccaaaactttttctgatatatttttttttttttaaataccagtgtaggcggacctgcacagttgaaacccatgttgttccaaggtcaactaaaaaatctgaaatctgaaatgcttcaaaattggaaacattttgagcactgatatgatgccacaggtgaaaaatttcacatatgacattatatgactggtcacagccaaaagacagtcaaaattttgtttcttgcacaaaattttacaaatacataaaattaccttcaggctacatgtatactatatgtagggaatgtaaataaatttagattgggtctcattcctaacatatcatgttatgatatgaaaatatttcaaaatttgaaaaaatccaaaatctacaatatttttggtcccaagcatttcatataagggataccatactccagaatgttagaatgtttatggctactttgtttgtagtacagggggaaaaaaaccatgatgagtctccatcagtaaaaagatagtttaaaaacttgtagaatttactcatatacatatatttacacatgcatatatgcacacatattatttttctctatatagagaaactgtgcattcatttaaagtgatatttcctctgttaattgacttggagaaatgttcatactgtgttgataagttggaaaatcagtttgtttacatgaggtgaagtggaaaagttaaactacattataaagtacattataggcttttcaaagggcaaaaaagtgtcacctgagatgaggcaatgaagtgctcatggccattcatccctgttttacaccaatagaaagaaaagtttggaaaatgatggatttctcaataaaatttcaaggaagtagaaataaatatgttactgtactaatgtattcatgtcttcttaagagaaatggaactccaaatttttagaatttttgaataggaatgatagaggaaagaaaacagaacactagtgactccggcattgtctgaagctgaggactgggctgtgggtaacccacaggtgatattactttagcctgaataatccagacgttatgatgttttggcctctgtgtccaagactcttgtagatttcttgtcaggccacaattctttgagtgagagtaatattttttcagtaggcaaaaatcccttgaaagatcaatccagggacatttataataagataggattagaaggtagactttaggctagggttagggttggaaaaatcaaaacacgttgttctctttagagtgagaaattggtttatcccagactttgaaggataatataatctataaccctctggttacgggaaagaagagacctacatgtggccatcttgggagcaaggcagagagcaggctggaagaccttctaggatggatatggacttgtgaaatgcagtagttaaaccaagttttctcagggttacatttgccttccatcattcctgaacactcatgtcatcatgaaattagaagagctgatccaatactattgataaggaaagagactctcctttccccaaagcgagagatagcagcaataatcagataatggcccagaagatggatgatcatacacacggcttgtgtgaggcttatggaagataaaacaaccacaatatttcagaaatgtttatatgttgtttacagttctaccactacaaagccttctagaatgtgagacagaatggtgtgatgattattctcagtataaccagattaagtaagatttcacaggtggagttaagaattaagaatttttgattcaagagtctcattcaccctcttccttctttgttaatagttctgttaggatctgcctttaatttgtcttttcctttagggcgctcaaaacaacacaaggattaaatgcctttctattgtcaaagttctctccttatttgccagttctttttttcatgtcccaatcataatcttaatggtatcgttgatcactcaagcaactaaccctgaagactgcccagtcgcaggagccaatacatctttttatgtttaaactcaatcacttcaaatgttgatcttaccttgtataatagaaattagtcgtagagactgtggtgggatgagatagcattgcgggtaatctggctcagctatggctgagtggaagaaacttgcatcaattatttatggttaatacagagtatcctagatcgtagttgtggactgaatacagacattcagctccctcccccactgagctctcataacaatgcagggactggaaagaatgtcagcatatgggatgggagaatgagaagacgggagcttcttgggcaggtattacgtagtgaggaagcagtgggtgagaacattcagtgagagaccacaatgtaaggagagagtctatctgaccagtggaagcagagactccagactcagaacctttggtacaaagagtaactacagcaaacgggcaaagaatagattgtgaatttggaggttatgtgcttccttctggcacatgaaaaaactcctaaagctttttgtgggtgcaaaatgaaataaaaatctttccccattggtatgaaaataagttaattagcctttacaatggtttgtttttgtgttactagtttccagttgtggctgtttctctcagtttctctctgttttggtttgtttgtttgtttgttgttgttttccttctcttaggaaactttggcagataattgggcacagaaattggtcattttttaaacactctaggttagtgattctcatagtccctagacatcggtatcagtattacccggcaacttgttagatatgcaaattctcaaatcttacctactgagtcatatactgccaagtgagccaaggaatccgtttaattaggctttgcaggtggttctgatgcacactcaagttgaaccactgctgaagccataactattggagacaatcttgcatagcctgaaaaatggagagctctaactgttgatagggctttgctttatttgtcttaagaaagcattaatgagaatagctttgtgtttctttgaagttctgggtgcttctgaaaactctaaaggttttcaagcatttaaatttctctagcccttttctcaaacaaacaaaaaaccccaaacaaggaaaatctcatagaaatataaaaatgagttaaaataagttgtgaggaatattctatacatcaacagtaaagtattactcaacctcaaaaattacgtctctaccataatctataatctgactggataaggactataaataaatagcatatgaaagtctacaataaagcagggagaaaatcatcactggctccgaatttcataatgacttcttgttgtatgtatgtaaatatcttctgaacaaattattgtacattttcctatctctggagaaaattaatgaattaggttaaacaatttcttaagtttaatggagcttctgttttccttggcttatgtatactagcacaggtaacttgctgaactgcagctcagaagaaaaaatctatagagaggtttagttctgaggtgaattaatggactttgttgttatgtcagaaggcgagaagcaagggaaggcaggcgggtaagagaatcgcataacgcaaaggacttcagtgcttcagaacaaaattgaagcgttttaaaaatttgactgaagtaaagttcagtaatatttttaatcatgggaaatccttggataaatgtatatggtttgataattttggtttaaattaattatgttttttctctgattttatcacaatcttagaattaatgttagcatatttttctggtttataaaatattttaacttaccagagctttctagatgtcccctactggatttatggctcagctgaattgaattattaaactagtattttttaaaacatttgttcctgtaacttgagatggggctacaaataattatactgtataggtaaaaccacacataccctacatggtaaaaaattcaaatttcatatgtaacacaattttcatgtaaatttttatattttagtataaattctctgcagtgtgtcagtttaaaatgaattttaacatactagttagctttatgagcttggctaatatttcattgagataattagtgaaaaatctttggatgagtctcataaaatttttaacatatccttgctgcatatttttacacattatagagtggctatcaagtaggagaatgaacagtatgtaaaagtacccttagttctgattaatgcacatgttcttttatactactttaagaaattaagtcagtttgagtatttagaaaagtgcatgcaatataattaatgtgtttttgcttatcaaggcaaagagagtaattttgtctaaaaggcaaattgtagagttttgctagaatataaaactgaattttaaaatacaaatttaagggcatacaataattgtagaatatctgagggaagtaaacttcatttgctatagcttataatagctgcaaataatgagtttaaatgagcaataaaacgtttataatttttggactaactttactcaatgttaattagtttgggcataaaacataaaagaacttttgagtcttttagtccaatttgttaaatggatggtctcaaaaaagtcatattagtatttgggttacctttttgataaaatgataaatcaatctccatatattagccttttttttttttttgagacaaagtcttgctcttgtccctcaggctggagggcaatggcgccatcttggctcactgcagcctctgcctcctgggttccagtgattctcctgcctcagcctcctgagtagctgggattacaggcgcctgccaccatgcctggctattttttgtatttttagtagaaatgggatttcaccatgttggccaggctggtctcgaacccctgacctcaggtgatccaccctcctcggcctcccgaagtgttgggattacaggcgtgagccaccactcccggccatatattagttttttagcaaaaatttaacacttgtattctccacagtgtcctaccggattagatatagctctcctggactaaattgtttctcacccacaacaatattgccatccgggagaaaagagatttatagtagtttactttgtactcctagaaatcctttcaagaagtataaaagtgaatacatacatatttaaatgataaacatttatcttcgtgataaaatagttaagtttccatgtgagtcaggtttaccacatgagtgatgaaccagctttaattaacaatataaccattctcctctgtcactgtaggctgttctaaaaaaagaaaaaagtttacaaaagccttaattaccttatgctatttggggagaattaagcaatgaatggagtgttgcatttaacaggttatagaaaatttttctgtgtccagcatataatcaactactaattttcagactggtttggcacaatatagattttctgccattgaatagaaactaaaaaatttgaaagtcagaaaattatttcccaggttctgaaagatatcaacaaagatatttttaattgactatgtatgattattgatttgagatttaatataccatgtctatgagaattctttgtaatacttctgcagtgtaatttgctacataatgaaaattcatttttcataataaatagtttccagaagtcatgttgtctttcttgctcccagcaagtagctctatttcttggccacattgaggaatcaaaatctaatgtaattcttctaaatagaatagagaacacctagagtcgctgctcctatgacaaatctttggataacaactctcatgtgcgtaagacattttctgatctcttctgtacttcaacttgtaaagaactttggacattacagtcagaaagtctgctattcctacaaagacaaaaggggaagcctctaaattccctgagttgtggggataattagctttcatactcatctgctgacccctgattatcagaagacatttttatctctttggcatgccccatcacctgctgtctgtctccaaaagacctgtagatcagagcaggcattgtaaggcagggacagttcctgaaatttccaattaactgatgatgggaaagctcagaaacacaaactctggggagtggctgcctggtactgctaatactcctgctggaaacaggggcacctgggctacaaacaaacgtaagactttggaagaaggtgcattaacttaattctgcctttcacatgtgagctcccaatttcccttgtggctatgagccacaagggcccaaattcaatgggagggtggttcgggtctaccatgacaagccaggatggaggagacagaggtcagttattgggagcccagattcttgccctttagaaacatgtgctgtagcagagaggaacccactacagctgggattctggactgacacagggagtgggtagtccatccagggtcacctgattgatagcaggcccttcacatctgcagcccccacctgtgacactgtttttgataccatattccccaaatttaaccctcaaatccaaaatagtaaaactactgagatgttacttatgaatacagtatctctgggtttctcagatggctgctgggaaactccagagatcctcctcctagctcttaacatgaagatatattagaaataaaggtaatgttttgcattctccagatatttaatttgctcaaaactatgctcaatatagtggaagctgctgtgtttttcaaggccatattctgagaaaatagcaataaaatcatcttaaattaattaaatgcaataattatgtatgattactgtggctatgttacaataattgtgcacttctcaggttggattcaggcatatttatgttcatgtacaaagactggtgcaataaatgtcaaccaactgattaaaaaaagtaaacttatcagttggtgacaaataataatatctactttgtggggaaaattaaaggccctggagaggtatcgggatgcactaattgttcttcatgtgttctgtcttttacggtaatcactgattaaaatttcattagatgagtatgtattacacctcaacagagaatgccactgtcccccattgtgatgttgtttgctatggcaaaaaattaaccaaactttacagttttattattagcaacatctcctccccctatccccgctgcttttttttttttttagatggaatctcgctctgttgcccaggctggagtgcagtggtatgacctcagctcactgcaaactctacctctcgggttcaagctgtcctcctacctcagcctcccgagtagctatattcaggtgcccgccaccatgcatggctaatttttctattttcagtagacacagggtttcaccatgttggccaggctggtctcaaactccggacctcaagtgatctgcctgcctcagcctcctaaagtgttgggattacagacatgagccactgtgcccagccctcctttccctttaagcatacctaaaagcctctctacaaagcgccaatcagaatttgagtcatctggaagaaatatcaaaagagctccagtaataatggtagcagacactgttgatactattgataccacaggaaattgactcatggatataggcctccaagaataggctgaccttgtccccacagacaatattccaactatacgaaataaatgagtcaggagttccaagacactcacagtgtagaagccgatgaattcatgaaagtagactgcttaactcaagaccagcacgacaagaggttgttatttaggattaaagggcctcagtaaggcaatttaattgaggctagtttaattttctactttaatgaacatgagagaaacccattttctttcttcttaatctacctttaatctccaattaaatgtacaaattattaaatttgtaaaaactaaataaaacactctgaattcttagtgttgaggaaaaaaataccttgcagaaattcttaatataaaaacaaagctaataagttgccaagaaaaacatacaaataattattttgtaaagaattgtgacatacaatatttggttttgtctattaacatacccttaattagcaatattgcttaaatcttgcacaaagtttctttaataaaaacatttactttatgtgactatgtagttatttgtattggttcaataagaatttgtcctcccttctacctgaatatattactaattagaaattttttttttttttttgagatggagtcttgctctgttgcccaggctggagtgcaatggcgtgatctcaactcactgcaacctctcaatcttgggctcaagcacttctcccacctcagcctcccaggtagctgggattacaggcacccaccatcatgctaggctactatttgtatttttatagagacggggtttcaccatgttggcctggctggtcttaaactcctgacctcaggtgatctgccggcctcagcctttcaaaatgctgggattacaggcatcagccaccttgcccagccaggaagaatcaattttttaataaaaaatttatagctgtgctacaaattcaatttaattagacaagacaaatccagtaataagaataatttctatgtttttcacgcagaagcgatgcctataacatccttctaggaaaccaatctggtgcttgctctatggactatgcaatctcaggcttggaggtaagaaagaatgtcctttcttggcagagcagggacaccgagacattggatatcttttattaaaaaggatacatttgcattataaatactgcagatgaaatcaggtagaggtgaacggactggtgtggtctgctctaaactgagctgttaaacatgtaaaagtaaatttaaagcacaagggctttataaatctatagatagacgtaaacttgtgagccttagtttattgtttcatcaaaaaaatactaggaggtcattaaatattaatcaacacttcttagatctgtgcaaataaaatggatcaaattaaaatgtaaaatcaatagtactgattaggaacattgttcagcaaatggaggtagacaaacatgtcctgtagagaaggaaacatgaccgcaagatgaagtgtaaaaaccaaagtgacattggggcctgacaccattgtcagcccgttcatcatgtcccactgctgaagaaacagagaaaaaaaaactctgcactctgacataaagaaacaataaaagggtctctctgtctacctgcagtcctccaaatgaataaaaccttgagcatttcctgagagttgctaactccttaatgaaaatcactttatccttgactttacaatgctgtttattgtctgaagatatgtcatgaactttctgaatacaataaccatgataaaattgctgttttctgccatgaagagattaatataaaccctatagtcttcataatattgtttgttttaaaaagttctatttttttaattttttgggcagttcttttgaagaatgacttcctcacatttctttgcaagtaaatgtctccttctgcttatttttccaacatgcttttgtttctgagcctttctttcatgctctatacacacaaatcagcaggagatagtacctgcagctgtatttggagtttactgcctcaatgttcactttcaatgaaagagcgtatttcttaacagaagaccagaaattcatgctgaaccaataaattgtcctctatagttttcatctgcaaggaggatttaaatatttctagctcagtagttcagccctgaagattatttcacccccactgctaatcccgacctaatctgtttttgtgttgttaatgctcctatatactagccaggtccgtaattctgtaacaggcttaatttcttaatattttaggccatgtgttaattttactatttcttagccatttttcctcaatagttttaaattgcatccctgcttactctcccttttactggatgggcttcctctgtttactaatacaattccccaaattgattcatccacttgttgaaatacctaattttaggccctgcactgacagcttgcctaggcttatacttgttgtgtttggtgttgcagtcttcagattctaaaaacaccatctagaccttacattacctccagccagggctattcccccagggcctgccttaagaagcagatttcttttcatgtttcatcttcttcccatttatttcatttcatgacagttagagaagctgtatactaacgtgacaaatgctaagttagcaaagaaaaacgttatttcaggataagttcagggaaagctttttggaggaaagtcagctcacattagtcctgatgatggatagtgtatagagactacagatgatggaacgatgaagtggaaactcgagtggctacatacggacattccacatagaagcagtgtgagcaaaaccaccaagaaaggaaatgagatggaattgataaggcaatgcaaataattcaggttatttagatcatcagtgttgggggaagctgggtttatgggaatcaatcgttaatcagaatgtgagcaccattggtttggtaattcatggaagaggttatcattcaacagggggagtggcttctcgattataaacatgtctgaaggtcactgaacatcaaggctatccttcagttaaaatcttattaaaattatactgacctctgatgaccttcagagagctccagctagatggattgatgataagagaaattcgagaaggcaatggggcaaatctttgtgcaaatctctgttatgtcatatatctaaggcttctgctggatccagtgatttgtttgttctgactgtagtacaaatctattggaacaataaatctagttataataaatgacagagggcattgaagcagatgcaagaagcaaaatatacaggtgtaaagacaaactatattaggcctcccatcaagcttctctaatattttcacagcacagccctgcctgacttctctctatctgggtaggccccttctgtttgctaaaccagttctctgatgttgactacctgattctctagtcctcaagttgactcatcctgtttattgagagtgacatttttagactactaataatatttatatgtaagaaagaaactgggtttttatataaatatataatcttttcaaataaaagattataatcaaggaactgtaaataatagaaaaattacataacgtttccctatttggggattggttaaatgcaatattatagaagtctgaaaaaataatgactgtattacaaaagaatataaaaataattgaagactaggaattatgtctaccaactaattcagtcatttggctgtttattctcatttgaacagtagtggattaagaaaaaaacaaaaagactttcgacttccatcacagggagaaaaggatcaagtacacattagagaaagctgatggcaatgatttctagtttcagtttctattttctgtcaattaaccatcattttggtaaacagcctttttaaatatcttttcttttaatttttaaatttttactttaaagacagggtctcactatgttgcgaaggcattggcctcaaactcatggactcaagtgatcttcctgccatagcctccctaggtgcacatcaccatacccagctattaatgtctttataaaagcatttttaaccctactggtctagctattgcatcaaataaatagctaattccattgacgaaggattagggactcacgagtgaaaataaatgttttatttggataatggctacaaaatctcaacagtcaaaataaataagagattaaagccatgatgatgacttaaaagataaagttaggtagaaatgtgaactaagggaaatgactcaacacattcagcaacacaaaactgtggcctaaattcactctgacagttgttatgctatctcctgctgcccgagtaaagtaagttatgaacaagacacatgaaggggatcaggcagacatatggtcaaatgctttctgtgcaatatgtctgtctccatattatcttctctgtctcattgcactttggacatttttattcttcctgcagatctatttttatgaagcaatgtgatttaaatgaaaagagcactgaattctcagccagatatttgagttctagttgaagatttatcacctagtggttatgagatttggggcaaattgcttaatctctctctttctttaccacttcgtttgtaagttttcttgcctcccttcaggactgtattggggatcaatcaatgttgagttgaaggcaacatggtttaagttggcttaatggagaagtggtaaatcacttaaacgggtagtgtttaagtgaacaacacagtgtagaggatgttgggctgcatgaggaagtgtggaaaaaaagcatgccatgaaaatatcatcacaatctcacatttcttcgtttatttgcacactctgaacacctgcatgtgataaagactgtgcaaggttctcaggatacccaggtaaaaatcaccacttctgccagtcttgactttgcaagcttgaggagcagacctggaggaatttggctattaccacaccaaagttgttcctcacattccctttgacatatggtctcaggaaaaaatgaaaagagtaaaaaaaaaaaaaaagtccttcatttttgaaaggaaaagtcataattaatttctagaaggagaaagaaaaaaagagataacagtgtgtgaaaggcttagaaaatgctagagcactacagaaagataacgtgagattatgtctaagagtagcttggttattttgcttttgttgacaaagtatacctccttcattttcatagttgtcataattctttccatgattttcttagtgggtttgtttaggagaaactgtattctttctttattcatctaactctccttaactccaaaagatgcttcttaggataacattttaaaaggatatacattacgcacatttttaatgcttctatacaggactgaaggccaatattaccatgataataaggcatgtaacaaaaatttgttctgcagagagtgagaaagcgtgagggaaaacacagtgcaggattctatgctgtcgcccaagaacccagacaggcaagtgaaataatagagcagacatttcctgaggctgtggtcgatatgattaggagatagtgggtaaaaatggcctttaaactatatacacatgagaagatagatgtgaaagcccattgcaaaggcaataaaattatgcaaatataaaatatcactattaaaatgtatgatgaattgacgtgccatgaaaacagttccagtgctgggccagaaatcaggaaacgtgggcttttggtttctcaccattaaaatgaagaagttggatttatacccaagggcaccttgtgggctgtatggcttctaagtaactggtcataacaaaagggacacaatcaggtcagtttcaaaccaagaataaaatgggaaattaaagaactgaattggctactttctgctcaaatgattgttaaaaataaagtttaaaaaaagccccaaggactatgcagtgcagtgagcagaggctcccgatattaaaaagaaaacaaggaaaatggattcctggtgatagaagtggtgtgggggaagacaaatagtgtggctgcaaatggaacaatatgcaaaagaaaagtagctaaatatagctcttttttgggaaagagattgtgtctaagtccatcagtggaaaggcaacttaattgttgtataagtctgttcaggttgccataacaagataccatacaccaagtggcttaaactatagaaatgtatttctcacacttctggaagttgggaagtccaagataaaggtggtagcaaagcggattcctttctaaggtctcttcctatggcctgtaagtggctgtagattcactgtgtgcccatgtgaccatttcttcgtgcaccagggggaaggcggacaagcaagctttctagtgtctctcttcttgtaatggcattaatctcagcatgaggacaccactctcataacctcttttaatcctgattacctttcaaaggccccagctgcataaatcatcacagtgggtgttagggcttcaacgtttaagtgcgggagttggtgttcacatttcagtcaattgaggtggcaattgaaatgagaaaggaaaaccatagttactagagagaacggttgtcttggggaggatcactggacaggactacggtcctgtccaggttgttatggcaacctgaacagacttatacaacaatccagtcctagaggcaatacaacttctctgctgattccagattctgagcgcctctcagtccttggttgggttgttttgatcctgtccatattatatttataaatattctcttcataaaactctctttaggccgggcgcggtggctcacgcctgtaatcccagcactttgggaggtcaagagatcgagaccatcctggccaacgtggtgaaacccgctctctactaaaaatacaaaaaattagccgggtgtggtagcgggcgcctgtagtcccagctactcgggaggctgaggcaggagaatggcgtgaacccgggaggcggagcttgcagtgagccgagatggcaccactgcactccagcctgggcaatagagcgagactccatctcaaaaaaaaaaaaaaaaaaaaacacaactctctttaaatcacacatccgagtgtgccccttgtttcccaccagagccaagactgaatgagatgatttcttaaggtcaggttgatgtcctaatccagttgtgctgctataacaaaataccacagagtgagtaacttataaacaacaaaaatttattgctcaagttatggaggatggtcagtccaagatcaagttgccagcaggttcagtgtctagtgaaggcccattcctctgtcatccaggctgaagtgcagtgttgcaagcttgggtcactgcaaccttcacctcccaggctcaagtaaccctcccacctcagcctcctgagtagctgggaccacaggtgctcaccaccatgcctggctaatttttttttttttttttttttttgtagagatggggtttcaccatgtttcccaggctggtctcaaactcctggactcaggcaatctgccagcctcctgagggagtgctgggattacaggcatgagccactgtgcccacccccaaaattctactcatatatatgcataattacatagttaccagccgttattttctgatactttgactggcaattggttgaaagagtttatctaaagacctggaatccatagaaggcagtctctgtgttaaggggttgttcttattatgcagatgaagcctccaggtagcaggcttcagagagaattgattgtaaatgtttcttatcagacttaaaaaggtgcctagattagggaaaaggcctggaaagggattccctgtagcatgtagactttccccacaagagacaactttgtagggacatttcaaaatatgataaaaaatgtattttagggtaaaatatttgtatttctttcagggcctgctatctgtcatgtaatgctacactagagtcagcctggagtttggtgtcttattgctacaaaaagtcttgagatcgctgttgtaatgtcagttgggcctggtcggatgtgctggtcagttgtgcctgaattccaaaggaaggagggtataatgaggcatatctgacccctacttcccatcatggtctgaaccagtttttcaggttaactttggaatgaccctggctgagaggaggggtgcattcaaatagttgaggggcttggaattttatttgtggtttacactatagaaagtatttttccagtattacctggacaatgtgtctccctgtcagtatccaggaatggcacctggatcaagcatttagtgttcagttgctacactctcacctaatccctcattttcaatattttgccatgttttccagtgacccaactggccaccatgtcacagactttatggtctccaagggagacccctccatttcatgttttgtgatttgagcaacagactggaatctacttgaaatttgcaaatggtctttgacttgggctttccaattttgctctacttcacagtgttttctgggttatatacaagggagatgatccagtcatttgttaagcgcctcaaataagacatgccctagatgtttttttgtttgttttgtcaaattgggattatctttgtgtctttggagaatataaaatactaacatgaggtaagcactaaggttctgagatggccgtggaagagatgacaaactccatcaccatgcctgagagtgtccaatcgtctctgcgggggccacatatttttgtattacactgtatttgaaataacaacaacaacaacaaaaaacccttcaagattcataaaattggacaactgtctttgtaacacttctagtggtaaaaccagtaaggatggctagtttgcaacccatctgagcagcctctctggtttcatagatatgttttctctctgacattgaacggctttcaacttgaaacggaatgctacatcacaaagataaacaggtttgaaaggaaccggttttccttgtaatcctaaacgttcaagtctgcgcattaaaagacattatctgaagaagggtgcacaagcttcctgttggccgccagaagggttctctgcaggacacagatcaagtaccacagtcttagggggagaccagacgcgggatctctgcacacctccccaaaggacaatggcaggaggaaaaggagaaagagacagacgtcacttcctccgccagctccggcagcgggttgatcggctgagtcggcggagggtggggcggaagagcagacggggactgggaaaggcgctgtcggtgacatcacggatagggcgatttctatgtagatgaggcagcgcaggggctgctgcttcgccactaaggagttcccgtgccgtgggagcgggttcaggaccgctggtcggacctgagagtcccagctgtgtgtcagggctaggagggctgtgggcggtgggggggtggggtggggggggggggcgttcgcggggcaagtgaccgtgcgtgtaaagggtgaagcgtgtgaggctgtggcggggcggaggtgcaaaagctcatacttacctggaaggggagataccatgatcacgaaggtggtttttctcagggcgaagcttatccattgcgttccggatgtgctgacccctgcgatttccccaagtgtgggaaactcgagtgcataatttgtgatagtagggaactacgttcgcgctttctcttggtgtttctgtggtgcgaatagtaggtgagccgtaagtgtttttgtaattcagggtgcgggctcgtgttttgtggctgtgttctgtccggtcagttgtttccgttcgcaacggttagttttcctttgtgaggccatgtttggggacagcttagaactatccacttgctctcttgggaggcgaatttcagtctctgttggttgggttgttctcccaggttagctgccgcggtacttgctaggtggagctcagggatcaagggtcgggagctttctggtttgttcagtgctcccagggcttctaacatctcttaaaaactctggtgttttctgtcatcctcggagttacctcttagcctctgtttttttgttgttgttttttccccccctccctaagacaagtctcgctgtaccgtccaggctggagaagtggcgcgatcttcccatctcaggctcccgagtaggacaaccgcacgccaccacacccggctagttttttctctttttttttttttcttttcttttctttctctttctttttcttttttcgtagcggtttcaccattctgctcaggctgggctccaactcctgggctcaagtggtccgcccagccttctgaagtgctgggattacaggtgcgatccatcttgccctggcagctcctgcttttcaccacagcattcacgggagtttgtaggatttctgtgctggggaaacgtgtactcagttaatagagccaggtggaagttgtactcagaactggtggttttctttggaatgaaaaccgtgcatgttgggggctcttagtgtccccgttcggttgtaggcataacacccttgctttgtgtagggggagggctttgcccatgccctggtgccccggcgcagggcatcgaggtctgcagttcagaaccgcagtctaacctatgtcttggcggaataccctgctaagtctccctggaatgtaagatgggaggtcttgtgaggaggtttctacaagtaagaaaacaaatttccattcggtttttattgacaaaattgaaaattataataactgagtccagcctctcagatgacaaatgtcttttgcactgagagctgggaaccgccgcttgcctcagctcctgcgtgcaggtgcagccctcgcttccctccacactttctccagcgggtgtcagttcctccaccagaggcagacagcgttctgcagaaccacagcgctcaaggccttcgagagccaaaaatctcggagcgagctgccctgtcctggctgtacctcacgactgacctagaaatggcctttgctgggagcaaagggtaggggggagatggtcgtcggagctggggcctgtgcactggaccaggttgacccacgggaggggaggtacccagagttagaagggggccaagcactgagacctcaccatcctcaatctccaaaaggactcagagagatgcagagactgagacaagcttcctttttcaaggaaagagaaaactactgaggaaggccccaggggctctgaaccaaaatccagacttttttttccacctgcagctttttgtttttatttttgcttgagaaggtgtctcggtctgttgcctgggctggagggcagtggcgcaatttcggctcattaaaacctccatctcccgggttcaagcaattctcctgcctcggcctccctagtagctgggactacaggtgcccgccatgacgcccggctaatttttgtatttttattagagacgaggtttcaccatgttggtcaggctggtctcaaactcctgatctcaagtgatccacccacctcagcctcccagagtgctgggattacaggtgtgagctaccgcgcccagcccgcacctgcagcttaatcccatttcgctggtgcaacttcatccttccgtatgctcaggccaataaacagtactgtaggctggtcgttctttgacccccatacatcctattggtcggaaaattatgttttctctttggttaaccgcagactttgatatgcacactctttcttggtctgaaacccacccaatagtcccatacgtagatttttggataaacatagaaatggacccttctgatctgaaagtttgaaactcgatatttgttttatttgagttccttccttcaggcctctcaaaaaagatatcaaagaactgaaagtcacccagacaatgagatgccggacccctcattcatcctgattgcttccttgcccctccctagttcctgttttctttcttttcttttttctttttttttcttttttctttttgagacagagtctccctctgcctcccaggctggagtgcagtggcgctatcttggctcactgcaagctccgcctcccgggttcacgccattctcctgcctcagcctcccgagtagctgggactacaggcgcccgccaccactcccggctaatttcttttcgtatttctagtagagacggggtttcaccgtgttagccaggatggtctcgatctcctgacctcgtgattcgcccgcctcggcctcccaaagtgctgggattacaggcgtgagccaccgcgcctggtctagttcctgttttcttacacattgtcacattctttccctgccatctaagcctctagttttggttggtcagggagatggatttgagactgagttctcatctcctccgctgcagcaccctattaaagcctcttccttggcaataaccgtctcagtgattggttttctgtgtggcaagcagcgggaaccccaggtctctgaactttgacaaaggaatctcctgataaaggcgggatcgattttactgaccaagctgaaaacgatcagacgtttgaaagccttaatctcggagcctgtcggagtttggtctgcccttgaggcttttctttgggcctaccagtcaaaatcagcctggccaaacctgtcttcaaggaccaggggcagggccggcttctcccgccgggtcggcagccaccttccccttccctgtgacttgaagagaagcttcagggggcgtttattcaatttgcgaggagcctgcgaggcgcaggtgcgcggtgactctgtggttcccaccgcacccgctgccctctttggtcctctcgctgtcaccggcgggcagtaacgttccgggtgagctagggctccgaagacaccaggcagggagggaccagtgggtaagggcaccgcccgtttaggtcctgcgcaggagggatccgaaaaaggtcttgaagaaatagaaagggagggccagatgcggtggctcacgcctgtaatcccagcactttgggaggccgaggtgggtggatcacgaggtcacgagttcgagaccagcctggccaagatggtgaaaccctgtctctactaaaaatacaacaagtagccgggcacggtgacgggcgcctgtaatcccagctactcaggaggctgaggcaggagaatctctagaacccaggaggcggaggtgcagtgagctgagactgccccgctgcactctagcctgggcaacacagcaagactctgtctcaaataaataaataaataaataaataaatagaaagggagagttggaagtagatcaaagagaagaaaagaaatcctagatttcctatctgaaggcaccatgaagatgaaggccacctcttctgggccaggtcctcccgttgcaggtgaaccgagttctggcctccattggagaccaaaggagatgactttggcctggctcctagtgaggaagccatgcctagtcctgttctgtttgggcttgatcctgtagcacttgattgtctctcctggactttccatggattccagggatgcaactgagaagtttatttttaatgcacttacttgaagtaagagttattttaaaacattttagcaaaggaaatgaattctgacaggttttgcactgaagacattcacatgtgaggaaaacaggaaaaccactatgctagaaaaagcaaatgctgttgagattgtctcacaaacacaaattgcgtgccagcaggtaggtttgagcctcaggttgggcacattttactttaagcgcactgttggtggaacttaaggtgactgtaggacttatatatacatacatacatataatatatatacatatttatgtgtatacacacacacacacacacacacagggtcttgctatcttgcccagggtggtctccaactctgggtctcaagcgatcctctgcctccccttcccaaagtgctgggattacaggtgtgagccacctcgcccaggccattttaattttaatttaatacttttaatttgaatacacaatccaaaaatcatataacaagtacaggaaacccactttatgccaagtttacaaaaacaggaaagatatgtcaatgacaaagcgtcaaagtggcaacatcctaaagtactgagagaaaaaaagttattctagaattctatgccaaattgaaatatctttcaaaaatgtgactgaaatcaggacatttaaagacatacaaaaaaatgacagaattcaccgaaccacactacaagaaatattaaaggagtcctccaggcctaaggataaggataccaaacagaaatctgaacctacacaaagaaatggagacgactgaaaatcgctatgtacgtacttggatgttggggtttataacatgtccaaaatcaaattccctgacaacactagcataaaggccagaaggggaggtataatgtcacttgatggcagacggataaagatgtattctagggaccctaaagccatcactgacataacaaaagaaagagttacagctaataagccaaataaggaaagaaaatagaatgatatataaaaaaaaaacatgtaatcgctgggtgcggtggctcatgcctgtaatcccagcactttgagaggccaaggcaggcagatcacttgaggtcaggagtttgagacctgcctggccaaaatggtgaaaccccgtctctactaaaaatacaaaaattagcccgatgtggtggctcgcgcggacctgtaatctcagctacttgggaggctgaagcaggagattcgcttgaacccgggaggcggaggttgcagtgagagctgagatggcgccactgcactccagcctgggtgacagagcgagactctgtctcaaaaataaataaataaataaataaataaacaaacaaacaaaaactgtgtaatccctatgctggagcaactgctctccaggcctctaccctatagaaatacacaaatggccaatgagaagtgtacaagaatgatcactgccgaattatttgcaatcataaaatagtagcgccaaagtaatttcaaagatacatgaaaatcgttttatttatttaacaaacacaaacaattgaacaaacaatggaagcaagtccttttgcctaaagaaacacagagggtcatgcggatgttgctcctccaaggatttcggtgttccccaacggctagttttgggtctagttcttctggaagatcttattcttggggagctacaggttctggcgtttggggctctttcaggttctatctccattttcccctcaattcctccccattctgctataataaaaaaaaattctcacctccggaagatcccgcctgtgcctccccgccagcctttcaggaggtctggacgtctggtccaccgctccccggcttctttccccgcttttgcttttcccctcccctgctcccgccctccggcctcaggacccgaccaccgcccagctgagcccccgcggctccacggcgcagaaggtgcactggaggccctgcccgttgccgccccgcggggtgtcaagaagtcaacgtaaataaatgctttgtaaaaggaacttccccatggaaaaatctctcatgatttccattctcaaggctcttcaaaggactaaaagctaaaaggatggattcattcgacaagtcctagtcctgcgccctggtgagtgccagaccctgctccccgtgagggggacccacgagccaccctcaccacgatccctgccctggtggagcccccgtgcggaacacaggatccgaagatggcagcggaagctccgcagcggccccaaaagcgactgggcagggagggcacaggctccctcactgggtgaaggcggcgcaaagaatgggaagagccatcccgggagccaccgggcgttcagcctccctagggcccccaggcggctcgggccggggtctcaaccggggcgtttccgggggtttctgaagcaggcgaggggcagggcgggcgaaggccattcggctatccttctggctccagaatctcccaacgcgcaggtgtccaacgtgaccagcgcgacttaccgctccaatctctccagttttccaaggccttgctcagtcctcctgccgggcgggccctgaggatgcaagggacggaggaagtttcgtgcgtgcgcccttcctatagcgcccagtagaactaacagtacctgtctctgtggcgcaatcggttagcgcgttcggctgttaaccgaaaggttggtggttcgagcccacccagggacgcctctttgagcttttaaagtattcatgcattgtcaatcactagataaatggggaagattttatcttcctggagtcctaagccactaatttgtgacttatccatgtcaagggccagcccacctccccaaccggattcttaaccgggtatctcctgaaatcctgggtttatacgtgtgtaactcaggaatcctgaaacagagacctaggaacccacttctggtgtgataaaattctaattcagtccgttatacgcttaaatgagtaatttacatgcctccattttttcatatgttaataataggaggtcagtaatatcccgaggatgtgcctggatttactgattgctctatcaataatgtgaccagtggaatcattcatcatcatagtgatcctctccatcatttttgaagagtatttttcctcagtttgtgcatgatttatttaacccttttcaaaatgtttttgttagccaggcatggtggcatgtgcctgtaatcccaggtacttgggattctgaggcaggagaatcatttgaacctgggaggtggaggctgcagtggaggctgcaccaatggaggctgcactgctacactcccgcctgggcaacagagcgagactccatctcaaaataaaaataaaaataaaaaaataaagtttttgagatgaggtaggtttcattgttttaggattacaaagaatgctgcagccacctttcttgtacacatatctggtcattgtggaaatgtctacaccgcagatatttctatagtgtagggaagttgatgcactattgctacattataggctttacatgatgcttctaatttgagtacattctgcaaatgtatctttcacgggagccgtaccaaataatattccaatagcaatatttataggaggaaaaatgtgcagaagtgcaattgagcttcgtgcctctccatggggtccatgttcataaaatggtggcattagcaatcatctgagagtggagtttgtggccctctgacatcaaaagctgaagcagaggacatgaaaaccctcactgtgcatcctctctagtctggccagaatcattcctaggtcggtggtctcttatcaggagggaatgctgcttgcttgttttgtcaaaatcacaaaactgagggaaagcatcaggccgttggttggtaacagtggtgaagcaagtctttccaaagggctggtttgttgttaacccttagggaaaaaaaaaagccttttttttttttttttttttttttttgagacagagtctctctctgtcgcccaggctggagtgcagtggcgtgatctcggctcactgcaagctccgcctcccgggttcaggccattctcctgcctcagcctcccgagtagctgggactacaggcgcctgccaccacgcccggctaattttttttatttttagtagagatggggttttaccgtgttagccaggatggtctcgatttcctgacctcgtgatccgcccgccttggcctcgcaaagtgctgggattacaggcataagccaccgcgcccggccaaaaaagcctaattcttaccagctggtgccgtgcagttccaggctcttggtgtcccaaacaaagacaccaagagcctggaactgcaccaaaaaccaaaaccaaggtaggggcaagatgataatcacagaatgtcaccggtatatgtttaggttcaaatactattatgagaagtggcaggtaaaggaggtaggaaaaagaaaacacatcatgtaattgactgttgtatggaaatatttgatgctgaaagttataatttaaaactataaaccaaatattagaagtgtgtctagttaaaagggaggaaaaccatcaaaaacatttttagtgcaatatttaacatgagctatacaacccttcctaaatgccaaaggcacacacagacacacacgcagacacacagacacacacacactcacactcacgaagaatacaaatgactagaaccaagaaatgtaaatacattctgctacgtatggtaaacatagcctacaatgtggaagagattagaaaataaacatggaaatgaaatgtttttattaattcgcatcagtacccaccaaaaccaatcagcataatcaaatattataacactgaatgtaaaaaacaatccagaagtccagagtgataggcaaaaggttttaattgtatagattaaaattaactttggacaaaaattaaaactcaggcagagaatgtcttcttctttttgcaacagcagacactagtaaaaacaaaggcacagtaaaaattgagacccaaaatttgcagtgtagagatatgaatataataatagacacaggcagggaggattaataaatgataaaatgtttagaggatgatcattagaatacaggatatttatactcttgaaaaccgctttcccaagtacttcttcattataagtaaggtgtctctaaaagggacagatctcctagacccctccttaaccaagtaaccagtcctgatatcataatggtgatggacaaactagaccttctctgcccgcagatgggctgaggttggaaactcacagcattgtctctgcagtgttcccggcaaaacgtttaggctgaatttaatcatgaagacattttcagacaacttcagaatgtagatcattgagccagacagctgacctgtcctctataaacaagtccatgtcaccaccatccatgacaacaacaaaaagatgaggaaatatttggggttcaaaataactaaagaaatgcagctacattatctttttacgttttttgaacccaaaatatctcttctcctttttgttgtgtgatttgtggtgatatggactatgtgaaggagacaggtcagttgtcctgctcagtgttctacattctgcagttgtctggtgattacctcctatgaaactcaggctaagcgttttctgcaagaacatggcattgttcatattctgcaccggcagagtcctgggtgacatgctgtctcctgccagcggctcctgactcctgttctctacaggatggaattgagaagagcagggctaaggcctcccaatgctgtttgtccatctagctgtggtcttcctaagtactgacaccaattggaggctgaaggactgtggcttctctaaccaaaggagcctagcgggttaacaattgtcaagagcagttggtggttctgaaatacaatcctcaaccaaggatccctcctgtgttacagatggatcagctaaaacaagccaacactgaagacacaaagaatgaggttaggttcattgaaaccagggtaacacctttggatgagctaaacacaaagatgacaatgaccttgagcaggtatagaagctcagagacatgcctgcaaaatgaaatccctgaggaattttgtagctacccagagatacgtggttcaaattaaaatgtctgactgatcactcccggcatgtgctgcacagttatgtgaacgtgtcacacctaacgtgggtccattgtcttcagactgagcacaggttgccactggcatggtttgagaataggaatacagccatgcccactgacccatcctatgtctgggcttccaaatggaactgtactttcattcaaatcttcacgtgcctataggtcctgcctgcaggaatgacatctctcggcttagtaagggctgtttattgtgggaatatgactcccatctggaacaccaggtggagacttgtcaccgtcaaagtaaaaaacctattgtccacgtaaagggcgaagctgatgtgctgttcctcaaatgagtaaaacacacttctgtagtgctggaatgagtcaggtagttcaaagtacattgacggagtagaataacatccatccagtgagtcctgtaagacttcaggctcttccacttccatcagcacgccgttgagcctggaaaaggagacaaaactaaagaagcagccagggaaaatcagaaaccacagagccccactagatttcagaagtcacataaggaagtggttagaaaagaaaaaggatagatccattaatgaggtaaaaaaaaaatttattgcctatatgttgggatagaacagggccaggtagaaaacaatgaaagagaaagacagagagagagagacagagacagagagagagagaaagtgacctagtgaattgcccaggtgacatactggtaagggagtcaaaggacactctgagttagtgtcctcatgacacacagcaaactgtgatcatgaaaagagtgagctcaatagttttccataaaatatgctcaaaattcgatgcagtggccatgagagtacagcttttgaagtatggtcaacctatggcacgttagtaaaagataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttcttttcttctttgatcttcttccccttcttttcttccccttccccttcttttcaatttctgcaataaattcagacatggacagacacattaagctgattcccctacacacataacaatccactgtctaatcctcacacagggacctcaggctccccagcataagaataggacactttgagagatatatttcaggaggcctgaaggctgttcatgatagaacttcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacagacacacacacacacacacacacacacacacacagacacacacacacacagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagattgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttgagtccaaatcatagttctgtgaattctttacatctgcctgggtccaatgtgctgagagcgggctcagcttgccacaggcatggctggagactaggaatagagccttgctcactgacccatttcatgtctaggcttccaactgagactacagtttcattacaacttatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacatctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacagagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacagacacacacacacacacacacacacacacacacagacacacacacacacagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagattgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatagttctgtgaattctttacatctgcctgggtccaatgtgctgagagcgggctcagcttgccacaggcatggctggagactaggaatagagccttgctcactgacccatttcatgtctaggcttccaactgagactacagtttcattacaacttatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacatctatccagtgagtcctgcaagacttcaggccctttctcatccagcagctccctgctgagcctggaaaagtgggaaaaagtaaagaataagccagggggaatcagaaaccacacagccccagctagatatcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtggggtttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcgagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacacacagacacacacacacacacagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaagtctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacatctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacacacagacacacacacagacacacacacacacacagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagaggtagtcttcaggaggcctgaaggctgatcacgatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacatctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttagtaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacagagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacacagacacacacacagacacacacacacacagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagagagagagagagagaggagaaagtgagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatgtcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagaggtagtcttcaggaggcctgaaggctgatcacgatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacatctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttagtaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacaaacacagacacacacacagacacacacacacacagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatttaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagaggagaaagtgagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacacagacacacacacagacacacacacacagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatagttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttggcatagaccagggccaggtagaaaagaatgaaagagaaagacagggagagggagggagagagagagagagagaggagaaagtgagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacacagacacacacacagacacacacacacagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatagttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttggcatagaccagggccaggtagaaaagaatgaaagagaaagacagggagagggagggagagagagagagagagaggagaaagtgagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcgagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaacaggatagatccattaatgaggtaacaaattattgccttcatgttgggacagaacagggccaaatggaaaagaatgaaagagaaagacagatagacacacacacacacacacacacacacacacacacacacagacacacacacagacacacacacacagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagttcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacttctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcgagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaacaggatagatccattaatgaggtaacaaattattgccttcatgttgggacagaacagggccaaatggaaaagaatgaaagagaaagacagatagacacacacacacacacacacacacacacacacacacacagacacacacacagacacacacacacagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagttcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacttctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcgagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaacaggatagatccattaatgaggtaacaaattattgccttcatgttgggacagaacagggccaaatggaaaagaatgaaagagaaagacagatagacacacacacacacacacacacacacacacacacacacagacacacacacagacacacacacacagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagttcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacttctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcgagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacacacagacacacacacacacacagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaattctcacacggggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacttctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagcgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcgagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccatgggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacacagacacacacacagacacacacacacagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatagttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagagagaggagaaagtaagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacatctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacgcagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtacggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcgagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacagacacacacacacagacacacacacacacacagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacttctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacagacacacacacagacacacacacacacagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatagttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagagagaggagaaagtaagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagactttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacatctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagtgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacgcagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtacggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcgagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacagacacacacacacacacagagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaatcatacttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacagtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagggagagagagagagagagagagaggagaaagtaagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatatcaggaggagtaattcaaccttcgttgaaaacatgaaattgaacacactcttgttttccctggacctggcatctccaggtgtcgacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcacggtagcgaggattttagacgctgaaattagagtgaaggatgaaatctacaagatctacaaaattgagacaaaatcagagttgtgtgaatttgtcacatctgcccaggtccaacgtcatgagagtaggattagggcgccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaacacgctgttgctccaatacgtaaaaggcacttctgtagggctggcatgagtcagtcagttcaagacaacctgaaggagttgaataacttctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaacaaattattgcctttatgttgggatagaacagggccaggtagaaaacaatgaaagagaaagacagagagagagagagagacagagacagagagagagacagagacagagacagagagaaagtgacctagtgaattggccaggtgacatactggtaagggagtaaaaggacactctgagttagcgccctcatgacacacagcaaactgtgatcatgaaaagagtgagctcaatagttttccataaaatatgctcaaaattcgatgcagtggccatgagagtacagcttttgaagtatggtcaacctatggtacgttaggaaatgataaggggaggaagaaatggaaacctaaacatctactgcaatgaaaaccaacagcaatgacagtaggagtaattcagccttcgttgaaaacatgacatcaaacacactctggtttccctgaatctgttgcctccaggtgttaacacagaattaagcatccacaattgctgaaagtcacctggggcatggtgggttttgatcttcttccccttcttttcttccccttcttctttccttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacaccgtgagagatatatttcaggaggcctgaaggctggtcatgatagaaattcctcggtttttctcccagaaactgtgggtaaaatgtccctattctagtagatcgttatcccaatatcatttgtcccaagtttgtgcaaacagttatgccatatttttccaatcaacttaaagcaaataccctcaaatgatttctaggagaaaaactgcaatatttagccctgtctcatcaaatactcagattgttcatggttgtgaggactttagacactgaaattagagtgaaaaaggaaatctacaaacccttgagtcaaaatcatagttctctgaatttgtcacatctgcccaggtccaatgtcatgaggataggatcagggcgccacaggtatggcctgagactaggaagagagtcttgctcactgacccatcccttgcctgggcttccaggtagaactagagtttcattcaacctacatgtgcctataggtcctccctgtggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccatagggctggcaggagtcaggctgttcaagacaactggaaggagttgaataacatctatccagtgagtcctgcaagacttcaggctctactacctccagcagctccctgctgagcctggaaaaggaggaaaaagtaaagaataagccaggggaaatcagacacaacagagccccaactaggtttcatgggtagcatagggaagtggttaaaaaactaaaaggatagatccattaatgaggtaacaaattattgccttcatgttgggacagaacagggccaaatggaaaagaatgaaagagaaagacagatagacacacacacacacacacacacacacacacacacacacagacacacacacagacacacacacacacagagagagaacgagctcagtgaattgtccaggtgacacactgatgagggagtaacaggacactctgagttagtgccctcaggacacacagcatacagggatcatgaaaagactgtgctcaataattttccataaaatgtgctcaagtttccatgcagtcgccatgagaatacagtttttgaagtctggtccacctacagtaggttagtaaatgataaggggaggaagaaatggaaacctaaatatctactgcaatgaaaaccaacagcaatgttagtaggaataattcaggcttgctggaaaagatgtaatcgataatgtcagcccgctctgttttccctgaaccaggagtctccagatgtcaacacagaagtagctgttcacaattgctcagttacctggggcatggtgggccttggtcttcttcctcttcttggtcctttttagttcctgcaatacattcagacagggacagacaaaataagccaattcacctacacccataacagtccactgtctaatccccacacagggatctcaggctcctcagcatgagaacaggacaatgtgagagagatacttcaggaggcctgaaagctggtcatgatattctttggtttgcatctcagaaccaagggtgaaatatccccattctggtagatcgttatcccaaaatcatttatcccaagtttgtgcaaacagttatgccttattgttcccatcagttcaaagaaaatgccccagatgatttctaggaggaaaactgcagtattcagccctgtctcatcaaatgcccagctcgttcatggatgcaagaattttagacactgaaattagaatgaaggaggaaatctacaaacccttcagtccaaattatagttctgtgaattttttacatctgcctgggtccaatgtgctgagagcgggctcagcttgccacaggcatggctggagactaggaatagagccttgctcactgacccatttcatgtctaggcttccaactgagactacagtttcattacaacctatatgcgcccataggtcctgcctgcggcaatgacatctctcgggtcagtaagggccacttggaacaggaatatcacccctatctggaagaccaggtggaggcttatcaccttcacggtaaggtactcactgtccacgtcaagagccaagccaaggtactgttcctccaatgagtaaacagcactgctgtagggctggcctaagtcaggcagttcaagataacctgaaggagtcgaataacatctatccagtgagtcctgcaagacttcaggctctttctcatccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagagagagagagagagaggagaaagtgagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatgtcaggaggagtaattcaaccttcgttgaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatattaagctggttctcctacacacataacaatccactgtctaatcctcacacagggacttcaggctcctcagcatgagaataggacactgtgagagatagtcttcaggaggcctgaaggctgatcaccatagagattccttggtttttgtcccagaaactgtgggtaaaattccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcatggtagcgaggattttagacgctgaaattagagtgaaggatgaaatctacaagatctacaaagttgagtcaaaatcagagttgtgtgaatttgtcacatctgcccaggtcgaacgtcatgagagtaggattagggcaccacaggcatggcctgagactaggaagagagccttgctcactgacccatcccttgtctgggcttccaagtggaactagagtttcattcaacctacatgtgcctataggacctccctgtggcaatgacatctctcagctcagtaagggccacttgcagtaggaatatgaccctaaccagaagactcagtggatccttatcaccttcatagaaaggtactcaccatccatgtcaacagccaagccaatacgctgttgctccaatacgtaaaaggcacttctgtagggctggcatgagtcagtcagttcaagacaacctgaaggagttgaataacatctatccagtgagtcctgcaagacttcaggccctttctcatccagcagctccctgctgagcctggaaaagtgggaaaaagtaaagaataagccagggggaatcagaaaccacacagccccagctagatttcatggctaacgtaaggaagagtttgaaaagaaaaaggacagatccattaatgaggtaagaaattattgcctttatgttgggatagactagggccaggtagaaaaggatgaaagagagagacacacactcacacacacacacaaacacacacacacacacacacacacacacacacagagcgagctcagtgaattggtcaggtgacacactgatgagggagtcaaaggacactctgtatttgtgctctcaggacacactgtgaacagtgatcatgaaaagcatgtcctcaataattttgcataaaatgtgctcaagtttccctgcagttaccatgagaatacagcttttgagttatggtcaactttcactaggttagtaaatgataagggtaggaagaaatggaaacctaaacatgtactctaatgagaaccagaaagcaatgtagtaggcataattcagacttgtctgacaagacaaaatcattattttcagcatgtactgttttccctggacttggcatctccaggtgtcaacatcaaattaactctccacaatttctcagactcacctgggacctgttgcctcttggtcctcctttttcacttgatcccaccgatgtcctgcaaataaattcagatgggccctcttacattaagcagttcttccttgcacacagaaacattcctctgtccaatcctaacacagggacatcagtcttgtcagtgtgagaacaggagactttgagagaaatattccagtaggcctgaggtcaagtcttgagaaaactggcttgggttctttcatgagccttgggcaaaattcccctgtgttggaatgttatcttccctatgtgctctgtcctaggcttctgtacacaaatgagaaattttttccccaataaattgtaggcaaatagttctaacacctcataggagagacacttcaatattaagctttctctcatcaaatacccagaatttgatagtttatgagattgtggacacagagatttgatgaaggggtgcaatgtaccagctcttgagtcaaaatgaaacttggttctacacagaagcatcagctattatggcttttgtgggtgaaaagtcagccatttatctagaaaacataccaggaacatgatggacagatgagctaaaacaagcgaacttagaagacacagaaaatgggaataaattcagtgaaacctgggtcacatctttcactgagaggtagacaagggtgacactggccttgggcgggtaaagaaccacacagacatgctttgggaacaaaactcataaggaattttgtagctggcaagagacatttaattcagatgagctgagctgacagacaactcctgggcatgtgctgcatagtttggtgtgagtttgccacacctgccttgagttcaatgtcgtgacaatcagtccaggttggcacgggcatggcctgagactaggaagagagcaaagctcactgacccaccccatgcctgtgcttcagactcgactccagagtgattgaaatctacattgatatataggttcagcccacggtgatggcaaatctcagcccaacaaggggcacaaggcccaaagattatggggtctacctgggccatgaactggagctttatcaccttcacagtgtagtactcactgcctatgtcaacagccatgcagacttgctgttcctctaatgagtgaaatgtgctgctgtaagactggtacgaggccaacatttcaggaggaattgagagagtcgaataaccttcatcccaggactcctgggggacttcctcctcttcagactcctgcagattcctgatgagccaggcaggacagggatgatagaagatttaaccaacagacattagacaacaaaacctcccagatgatctgatgggagacagaatggagtggtcacagaaaccaaaggcatttttccttcaagagaaataaaactatccttctaaatgcagggtggagggtgactgctctggggacagagcaaaaatgggcagcatgtgctcagtacatttgccacagatgagccaactcagggcacccagactctccctgtaaactaccatcatgacttgcagcacagagaactgacacagggcttcaactactttgcataaattgggttgaattttacatgcagcattcaagtgaagagagttcttgacgcagtgcagacacagatcttgtgtattaagggccccattttcccaatattttgatataatatatttactttttcaatttcttttcttgcaaaaatactagccaacatactaccaacaaataggaaaaaagcatgtatacacctctccctggatttaaacacatcggagagaataggcaacaccaagaaatccctgtttgagggtctggagtggacttccagcaaactccaacagacctgaagctgagggacctgactgttagaaggaaaactaacacacagaaaggaataacatcaacatcaacaaaaaagacatccaccccaaaaccccatctgtaggtcaccatcatcaaagaccaagggtagataaaaccacaaaggtggggagaaaccagagcacaaaagctgaaaattccaaaaacctgacatcccttctcctccaaaggatcgcagctcctcgccagcaatggaacaaagcaggatggagaatgactttgatgagctgacagaagtaggcttcagaaagtcggtaataacaaacttctctgagctaaagtaggatgtgcgaactcatcgcaaggaagctaaaaaccttgaaaaaagattagacgaatggctaaccagaatgaacagtgtagagaagaccttaaatgacctgatggagctgaaaaccatggcacgagaactacgtgatgcatgcacaagcttcagtagccaattcgatcaagtgcaagaaatggtatcagtgattcaagatcaaattagtgaaatgaagcgagaagagaagtttagagaaaaaagagtaaaaagaaatgaacaagcctccaataaatatgggactatgtggaaagaccaaatctacatttgattggtgtactgaaagtgacggggagaatggaaccaagctgggaaacattcttcaggatattatccaggaggacttccccaacctagcaaggaaggccaacattcaaattcaggaaacacagagaacaccataaagatactcctcgagaagagcaaccccaaaacacttaattgtcagattcaccaaggttgaaatgaaggaaaaaatgctaagggcagccagagagaaaggtcggattacccacaaagggaagcccatcagactagcagcagatctcttggcacaaaccctacaagccagaagagagtgggagcaatattcaacattcttttttttttccatatgtatagttttcctttattattttttgtgtgtatgtatatatatatatatatacagatatatataatactttaagtcttagggtacatgtgcacaacgtgcaggttagttacatatgtatacatgtccacattggtgtgcttcacccattaactcatcatttaacattaggtatatctcctaatgctacccctcctccctccccccaccctacaacaggccccagtgtgtgatgttcccctttctgtgtccatgtgttctcattgttcaattcccacctgtgagtaagaacatgcggtatttggttttttgtccttgcaatagtttgctgagaatgatggtttccagcttcatccatgcccctacaaaggacatgaactcatcattttttatagctgcatagtattccatggtgtatatgtgccacattttcttaatccagtctatcattgctggatatttggcttggttccaagtctttgctattgtgaatagtgccacaataaacatatgtgtgcatgtgtctttacagcagcatgatttataatcatttgggtacacacccagtaatgggatggctgggtcaaatggtatttctagttctagatccctgaggaattgtcacactgccttccacaatcgttgaactagtttacagtcccaccaacagtgtaaaagtgttcctatttctccacatcctctccagcatcttcaacattcttaaagaaaagaattttcaacccagaatttcatatccagccaaacaaagcttcataagtgaaggagaaataaatcctttacagagaagcaaatgctgagagattttgtcaccaccaggcctgccttacaagagctcctaaaggaagcagtaaacatggaaaggaacaaccggtaccagccactacaaaaacatgccaaactgtaaagaccattgacgctaggaagaaactgcatcaactaatgggcgaaataaccagctaatatcataacgacaggatcaaattcacacataacaatattaaccttaaatgtaaatgggctaaatgccccagttaaaaaacacagaatggcaaattggataaagagtcaagtcccatcagtgtgctgtactcaggaaacccatctcacatgcagagacacacataggctcaaactaaagggatggaggaagatctaccaagcaaatggaaaacaaaaaaaggcaggggttgcaatcctagtctctgataaaacagactttaaaccaaccaagatcaaaagagacaaagaaggccactacataatggtaaagggatcaattcaacaagagttaactatcctaaacatatatgcaccgtatacaggagcacccagattcataaagcaagtcctgagagacctacaaagagatttagactccacacaatcatcatgggagactttaacaccccactgtcaatattagacagatcaatgagacagaagcttaacaaggatatccaggacttgaactcagctctccaccaagcagacctaaaagacatctacagaactctccaccccaaatccacagaatatacattcttctcagcaccacatcacacttattccaaaattgaccacatagttggaggtaaagcactcgtcagcaaatgtaaaagaatggaaatcacaacaaactgtcagaccacagtgcaatcaaattagaactcaggattaagaaactcactcaaaaccgcacaactacatggaaactcaacaacctgctcctgaatgactactgggaaaataacaaaatgaaggcagaaataaagatgttctttgaaaccaatgagaacaaagacacaacatatcagaatctctgggacacatttaaagcaatgtgtagagggaaaattatagcactaaatgcccacaagagaaagcagaaaagatctaaaattgacaccctaacatcacaattaaaataactagagaagcaaagcaaacaaattcaaaagctagcagaagacaagaagtaactaagatcagagcagaactaaaggagatagagacacaaaaaacccttcaaaagatcaatgaatccagggctggttttttgaaaagatcaacaagaaaaccctgtttggctagttcacctggctcatctgatggcaagttcctatcttgagaggactatgaaattaaaaccaatacaagtgctacaaataacatacaacattgtaaatcagcacaatttgtagctgggtgaatggaagaaatagttctattcatcacttcctcattttccctaaatctacaatctccagatgtcactactgaattaacagccaacaattccacaacattacctgggagacactggccctttttcttcctcttcctcatcatcactttcattttctgtaaataaattcagagaagcaggtcacattaagcaattcatacttcacatatgaacaaatcactgtccagtcatagcacaaggacataactattctcagtgcaagaataaggattctgacaggaatattctagggtgtcctagattaactttggtgagaattagataaccctgctttccagacccacaggccaaaatctccctctacgtgtagaccataatgccatattccctgcctgagtcaaagttaaacaaaattttttccccaaaaaaatctccaaaaattggtcaaacaattttctaagagtgctgctgcgatacggacttatatcaccaggtaacatggacattaaatgtttagaggcatctatacatgaaacacgactgatagataaatttgaacaactcttgctttaaaaagaatctgtgatttgggaggccaagacaggtgaatcatttgaggtcatgagttcaggactaccctggccaatatggggaaaccctgtctctactaaaaatacaaaaattagccagatgtgatgttgtgcacctgtggtcccagcaactcaggaggctgaggcaggagaatcacttgaatctgggaggcagaggttgcaccaagccaagatggtgccactgcactccagcctgggtgacagagcaagactccatcacaaaaaaaaaaaaaaaaaaaaaaatccacgatgctacaaagaaacattggatcagccattgcattgacagggtggagaaccagggtccagccttgctttatggaaatatatcagcaaagtaaagaagaaaagtttctgtcctgatttcagggtgactgtgcagctaagcaagctgacttaaaggagatccagatgaaagctgagagcagtgaagccgggggaacaatatttccaaatacaaaggcaaggctgccagcttccttaaacaggcatagaaattccatggacattgttcagggacagaggacttaatcacagatgacaagagatactgaatcgaagctagtaggcctgacagatactgcctgtgcacctcctgcactcaggtgactatgagattgtcacacttgcctggggttgagtaacttgatactggggactggcagacaaagtcatgacattagctgagaaggacaaaaaaagtccctgatatctgtttagaaacccatcacagttttttattcaaatgaatttgtgtttatagagcctgtcttcagagtttatcttcctcagcctagagagaggtatgagacacaaggaaaacagaggctacctggaataatgtgtacagcatcctcccattcaacatgagaggatgagccaatcagagttgagtcgactttgtcttcctcaaatgtgattttggttttcctatgtggctggttggagtcataagggccatggctatttgaataagtgatggcacattcctcctgtgagtcctcagggacttccttttcttcagccttctgcatctccctgatgagccaggtgggacagagatgacagaagattaaacacagagggattggaccccagggagtcctagctggttttgacaggcggcattaagagagtggtcccagaaagcaaaatggaggttcccattaagggggaacatgcaatcctgttctctctgcaacagagcatggctgccatgggaaccagagaggaagagagcagctgctgttcattgcactggacagataggagctgaggaggatgaagactcagctatccctgtacggtgcagacgtgacactcggcacacacagagaaacatgacagctgccgcaccctgtgtctaagctgggttatatttcacatactgtggccaagcaaatgtgggtttttggccgatcatagatgccagagagggtgtgcctcctagatattcctcatatgttaccatccattaattgttcctgagtattcagtgttacctgggggcagacgatttctgcactttctcagccaactcaacttgaacatcttcatcgtcatcgttgtcattttctgtaaatacagaagtgttcgttcagatatttcccacttcacagtctgcaagcacagtcagcccaatgtgcaacagagacatgaacatctaggcatgggtcaccgttcaactgaaaactctcatgttttatctttaacagaatgccctggcatggtttcctgatccatcaggcaatgcatttctgatctggagggccaccatcaagatgtggccaaatattgaaaagaccttttgcttcccatatcactggaggcttgtgcagcctctctctggacgttggcagctgtctcccccatcctgccagatctgattcccaggcacaggcttggtgtcctgtcacggtttgcatttcaaacctcattctttctcttagaagcagacaaacttgtcccacagtcctctatgcatcagaagatttcaagcctccaagtggcttctgctgtgttcttcagggacattctatccatggggagtgctccagtctgaagcacttcctaccacaaaacgcccccacataaagtgccttctccaacatcacacggcgagggccttcatctcattttggaaagcagttgtaagtgttcccacatttgaatgcttcagacccttgcaagagacaatttgtctgccacggagagagagaaactcaggaaggacaagtcattcactctctgacagttactaagaacattgccgaaaagacagcctgggaaccttcattcttagtgcagagctctttcactctaacaagcctgctcccatcgcagcctccttcctgtcctttaaaactagacagatgctgcctcttgctccaaagaccaccttccatcaagggaggagggacacttgcaatactgtgacctccaaccccatgggtttcccatctccgttcttacccaagaagtcctggtcatgtcatggccacataagcttagtggaaaaaaacaccattgatacaactgtcattgtgaaagtatggaggtctggagtctctcataagcctgggattttgggtcatcagggcctatggccaccttacctgggctgagcttttggacaaggtgctgtgccagtctacacccctcagccagctgttcttggaggtcctgcccctgggacttgtccggctcatccggagtaaggagggcctggagatgctcattcaatgagcgggaggcatctctcccttcccgcaacttctcccttaactgggtcagctctcgttcctgagcgtgaaccaggactttatattgcctaaggtgagacggtagagaaaatttaagagtggaaaggttcagtgatccgctcaaatattgcaacagagatttctgagataatgtcctcaaggagacctcgaagcagaaggtcagcacatgtttaaaggaatgtctgtggccaagagaaagaatagaaaatggtttacaggcttcctctgtatcagagagggctcttgcaagatcctcgatgatgttccattcatctttcccttctgtaaacaaaagtaggtgtcttcctaattccgtttcaaaaagacatcctttcagttcctcactctggccatggacatttccatgtgaaaatacacatagtgcatcttgcggccactagatacaaagctatgtacagaaatgaggccaggtgcagatggggcgaattgaaaagacgaaagaagaaaagaatgacagggtcgagaaggcaacattgattgagtgaaagaatgagaagccgcagtcagtcaggaggtgattgtcactaagggtaagtggggtggtgatggcacaccattttgagtatactgaatgctgctgtgtggttcacactcctttggttaattttgtgttatgtaaatttcacatcaacaattacttgtttgaaaaagagaaaacaaggctctgagaaacaactgcaacccatacatttttattatccttcttctctgtttgataaatatttatgtgtagcgagcctgccatggcaattcctgcccttcccctggcccagcttagctcttacgtctccccaccgagctgctgtatttcagagatttacacacctgcccccctgcctgccaccatggggtcccctcacctgagctcctcagcttgcttgagctgctctgcaagcttctcctccttgaactgtcgctcattcctcagcatagattttatgaggtctttgcactcttcatattctgagaaaagacagacacgcctgcctcagtggaaggctggacatgctgctgtggtcattgcctacagggcaggagccaggtccatcccaaggacaaaactctccccagtaccagggtctagacagggatttccacatctttactcttcagtctcctgactttctggcatctgatcctccaaaatttagagatgaagaaagagaacctcaagggcacatcaaggaagttgacaagatgattcaaccacaacgaagtggagtcagaattcacagtccgtgaggtctgactctgaatgcggggccactttcccaagccttgcagcctctcctctaaaacactgcactggggcatgaagtagtgatttcttgtacagtcgggaaggcccctaggactatgggactgatggtttcccttttactgggaatttcaaggacaagtatgtgaaagatttttaaaatctttgatttttaaatcatatcttcagttatgattttaagaatcatatctgaagcataaagtgtgacacataacaccttaaggccatgaaggaaatatgcccaaatgttaataaagtttgtgttaatttagaaacagcagaatgaagaactaataaatagtgttcactgtgtgccaataaatgttctaggagattgacaagaaatagctcatgtaattcactgcagcaatttacagaggtaggtattattgtagtaccctctgaacaggtgaggaaactgagggacagacaagacaagcaacttggatggagcccaggagacaggcccactgtccctgctctgtacactgcactgttatctccacacattctcgggtgcgatctttcttcctctttagcaacaagactctgtgccccaggaagcaggacttcactctcaccaagctactctctgctttttattcttatttatcattattattattattatttttaccagtcttgccctgtcgcccaggctggagtgcaatggcaaaatcttggctcactgcaacctcagcctcctgggttcaaaggattctcctgcctcagcctcctgagcaggggtgattacagtcacctgccaccacgcccatctactttttgtatttttagtggagatggggtttctccatgttgcccaggctggtcccaaactcctgacctcatgatctgcccgcctcagcctcccaaagtgctgggattacaggagtgagccaccatgcacggcccctactccctgctcttgatgctgtcacttatagacagcacaggttctattaggagtagactcctcttgaagcccctcagagcaggtactggctactatcaccaagtttccctcagagtcactagaacagagctttgcctgttgggcctcaacagaaacttgaactgaataaaagttcactagtctcagacatttagaacaacagactagatgttatttgtctgcaggatcttatatggtagagaggattcttgaaaacacgattgagcctcttggagaaaacagatcattctgtgcctgtgtcagaaatcaataaatggcagtttaactctagtcccacccccatctgattgcaaacatggaaagttgctaaatactttggtacgtctgtcttccaactttgacaaaatgttaaaatacccatttctgttttcctagaagtatggggaggatgacattatttttgatggagagagcatttagtgtctcagaagacaggacatcattcatcactttcatgatggtgagcctatagatcttactgtatttcttctgctggttggccaggaagccggccagttgagttacaaaacatctctctttgaggtttctgaactgctgtttcttctctgccagctgggggtgcaatttctcattgatttctagaatgttcatctctgccttctcgctggacaaagggccggctgataccaccatgctgacgtttgtggcagaagaggtggggccagggactggggagaagaaaggcaaacacatgatgggttaaaactggtgaaatcaaataggcttaatcaggactgagggatgtcactggcagccttgtgtacttatttgaagatgatgtttccctggtttcactcttgtcatctccagtcttgatctcctttaagtcaacttgtcttagctatgcagtcaccttgaaaccaagacataaacacttctacacttttcttgcttatacgtttctataaagcaaggcttggccctgagatttttaccccatgagtagccaatgtttctgtgtagcacaaaagatttcattttgcttttttaatttttttcttttttggttttttgttttttgtttgagatggagtctcactctgtcatgcaggctgcagtgcagaggcacaatctcagctcactgccacctctgcctcccgggctcaagcgattctcatccctcagcctgccaagcatctgggattacaagcgccaagtaacatgccagctaatttttgtatttttagtagagatggggtttcgccatcttggacaggctggtttcgaactcctgacctcaggtattccacctacctcagcctcccaaagtgctgggattaagatgtgagccagtgcccctggtcacagacttacttttttttttgagatggagtctcgctctgtctcccaggctggagtgcagtggcacaatctcggctcactgcaagctccggttcctgggttcatgccattctcctgcctcagcctcctgagtagctggaactacaggcgcccaccactgcgcccagctttttttttttttttttttgtatttttagtaaagacggggtttcaccgtgttagccaggatggtctcaatctcctgacctcatgatccacccgccttggcctcccaaagtgctcggattacaggtgtgacccactgcgcccagctgagacttattaatagctaagacaagccaatgaaaaggagagagagtctagcctgacagaagtgaatgagggtgggaggatcatctcagcccatcctcccacctaagtctcctgagcagttgggactataggcgtgcagcaccatgcctgcctaattttttgtattcttcgtaaagatgggtttcaccatattgtccaggctggtcttcaactcctgaactcaagtcatcgtcccacttgggccttccaaagtgctgtgattatatgtgtgagtcacagcacctagctccatcctagtttctgactaaaacaataacaatatgtgtatatacagcctgtcctcagaattgatcttccatagcctagacagaggtatgagacacaaggaaaatagaggctacctgggagaatgtttagagcatcctgacattcatcatgagaggattctctgtctacaaccagagttgagttgacttcgtcttcctcaaatgtgattttgatgttcttgtgaggctggttggagtcacaagggccgtggctatttgaacaagtgatggcacattcctccagtgagtcctcagggactttgctctcttcagtcttctgcacctccctgatgagccaggtgggacagagatgacagaagattaaacacagagggattggaccccagggagtcctagctggttttgacagacggcattaagagagtggttccagaaagcaaaatggaggttcccttaaagagggaacaggcaatcctcttctctctgcaacagaccatggctgccacgggagccagagaggaagagagcagctggtgttcagtgcactggacagataggagctgaggaggatgaagactcagctatccctgtatggtacagacatgacacttggcacacatagagaaacacgacagctgccgcaccctgtgtctaagctgggttgaatttcacatactgtggccaagggaatgcgggcttttggcccaccatagatgccagagagggtgtgcctcctagacattttcatatgttaccacccattacatgctcctgagtattcagtgttacctgggggcagatgatttctgcactttctcagcctcctcaacttgaacatcttcatcctcatcttcgtcattttctataaatacaaaatgttcattcagatatttcccacttcacattctgcaagcacagtcagcccaacgtgcacagagacatgaacatctatgtatggttcagcattgtactgaaaactctcatgttttatctttcacaaaatgccctggcatggtttcctgctccatcgggcaatgcatttctgatgtggagggccaccatcaagatgtggccaaatactgaaaagaccttttgcttcccatatcactggaggcttgtgcagcctctctctggactttggcagctgtctcccccatcctgccacagatctgattcccaggaacaggcttggtgtcctgtcacagttcgcatttcaaacctcattctttctcttaggagaggacaaacttgtcccacagtcctctatgcatcatgagactgcacaggccctccatgtggcttctgctgtgttattcagggacattctatccatggggagtgctccagtctgaagcacttcctaccaccaaatgaccccacatcaagtgccttctccaacaccacatggagaggggcttcatctcattttgaaaagcattcgtaagtgttcccatatttggatgcttcagacccttgcaagagacaatttgtctgcctttgtagatggagagagagaaactctggaaagataaatcactcactcaccgacacttactaagaacattgccaaaaagacagcctgggaaccttcattcttagcccagaactcttttcactccaacaagcgccctcccatcacagcctccttcctgtcctttaaaactagatagatgctgcctcttgctccaaagaccaccttccatcaaggaaggagggacacttgcaatactgtgatctccaaacccatgggtttcccatttctgttcttacccaggaagtcctgatcatgtcatggccacatatgtgtagtagaaaaaaaccccactgatacaactgtcattgtgaaagtatggaggtctggagcctctcataagcctggggttttgggtcatcagggcctatggccaccttacctgggctgagcttttggacaaggtgctgtgccagtctacacccctcagccagctgttcttggaggtcctgcccctgggacttgtccggctcatccagagtgaggagggcctggagatgctcattcaatgagcgggaggcatctctcccttcccgtaacttctcccttaactgggtcagctctcgttcctgagagtgaaccaggactttatattgcctaaggtgagacggtagagaaaatttaagagtagaaagggttgagtgatccgttcaaatattgcaacagagatttctgagacaatgttctcaaggagaccttcgagcagaaggtcagcacatgttgaaaggaatgtctgtggccaagagaaagaacagaaaatggtctacaggctttccctgtatcagagagggctcctgcaagatcctcgatgatgttccattcatctttcccttctgtaaacaaaagtaggtgtcttcctaattccgtttcaaaaagacatcctttcagttcctcactctggccatggacatttccatgtgaaaatacacatagtgcatcttgcggccactagatacaaagccatgtacagaaatgaggccaggtgcagatggggcgaaatgaaaagatgaaagaagaaaagaatgacagggtcgagaaggcaacattgattgagtgaaagaatgagaagacgcagtcagtcagaaggtgattctcactaagggtaagtggggtggcgatagcacaccattttgattatactgaatgctgctgggtggttcccactcctttggtgaattttgtgttatgtaaatttcacatcaacaattacttgtttgaaaaagagaaaacaaggctctaagaaacaactgcaacacagaacttattattatccttgttctctgataaatatttgtgtgtcatgagcctgccatggcaatttctgcccttcccctggcccagcttcgttcttatttctccccgccgagctgctgtacttcagagatctacacacctacccgcctgcctccccctacggggtcccctcacctgagctcctcagcttgcttgagctgctctgcaagcttctcctccttgaactgtcgctcattcctcagcataaattttatgaggtctttacactcttcatagtctgagaaaagacagacacgcctgcctcagtggaaggctggacatgctgctgtggtcactgcctacagggcaggagccaggtccatcccaaggacaaaactctccccagtaccagggtctagacagggatttccacatctttactcttcagtctcctgactttctggcatctgatcctccaaaatttaaagatgaagaaagagaaactcaagggcgcgtcaaggaagttgacaagatgattcaaccacaacgaagcggagtcagaactcacagcccctgaggtctgactctgaatgcggggccactttcccaagccttgcagcctctcctctaaaacactgcactggggcatgaagtagtgatttcttgtacagtcgggaaggcccctaggactatgggactgatggtttcccttttactgggtatttcaaggacaaatatgtcaaggactttaaaaatatttcatttttaaatcaatattcagatatggttttaagaatcatatctgaagcataaagtgtgagacataagacaataaggccatgaaggaaatatgcccaaatactttattagtatgagaggcagcattaagatttagattagttgtgttaatttagaaacagcataagattagtttgtgttaatttagaaacatcagaatgaagaactaatagatagtgtttacactgtgccaattaatgttcaaggagattgacaggaaatgcctcatgtaattcattgcagcaatttacagaggtaggtattattgtagtaccctctgaacagatgaggaaactgagggacagacaagacaagcaacatggatggagcccaggagacaggctgagggtccctgctttgcacactgcactgctgcttccacacattctcgggtgtgatctttcttcctctttaggaacaagagcctgtgcaccaggaaacaggacttcgctctcaccaagctactctctgctttttatttttatttttgatttatttatctttttgtttgtttgttttttgacgagtcttgccctgtcacccatgctggagtgcaatagtgcaatcttggctcactgcaacatctgcctgctgggttcaaaggattcttctgcctcagccacccgattagtggtgattacagttgcccaccacgacgcccatctactttttgtatttttagtggagatggggtttctccatgttgcccaggctagtctcaaactcctgacctcgtgctctgcccgcctcagcctcccaaagtgctgagattacaggagtgagccacgttgcacggcccctactccctgctcttgatgctgtcacttatagatagcacaggttctattaggagcagactcctcttgaagcccctcagagcaggtactggctactatcaccaagtttccctcagagtcactagaacacagctttgcctgttgggcctcaacagaaacttgaactgaataaaagttcactagtcctagacatttagaacaacagactacatgttatttgtctgcaggatcttatatggtacagagaggattcttgaaaacatgattgagcctcttggagaaaacaggtcgttctgtgcctgtgttagaaatcaataaatggcagtttaactctagtcccacccccatctgattgcaaacatggaaagttgctaaatactttggtacctctgtcttccaactaacaaaatgttaaaatacccatttctgttttcctacaagtacaagaaggatgaaattatttttgatggagagagcatttagtgtctcagaagacaggacatcattcatcactttcatgatggtgagcctatagatcttactgtatttcttctgctggttggccaggaagccggccagttgagttacaaaacatctctctttgaggtttccgaactgctgtttgttctctgccaactgggggcgcaatttctcgttgatttctagaatgttcatctctgccttctcgctggaccaagggccggctgataccaccatgctgacgtttgtggcagaagaggtggagtcagggactggggagaagaaacccaaacatatgatgggttaaaaactggtgaaatcaaataggtttaatcaggactgagggatgtcagtaactgaaattcttaccttactgttgtgaaaaatgtgatcactccccacagcactttaggatccttcaccacaaaaacaaggttcaaggtgcctcaactcagagctgaaagcactgccagtagctcagactctgataagagtgaggtagattgtggccagcgtgccaggtaaccgtctgcagttgcaataacagaattagaaggtgggggtgtcatggaatcttaggagccctgcattccaattgcccaggctttgctgaaacacaggcaccctagtctcacctgagggtcaccaccaatggggatcattccttcagcattcactctcagtattcgtgtacccttgtgacaatgccacagacccgtgtctttcccaatacatctaagcatattcctcactgtttatctcttgtctgtacaacatcatcaaggcagaaacagtttcccaacaggttatattttcttaatggtagtcatgaagtcataaataaaaaaatggaatcatttagtatgttctcttgttttgactttttctttttttttttttggagacagagtctcactctgtcgcccaggctggagtgcagtgacgcgatctaggctcactgcaagctctgcctcccaggttcacgctattctcctgcctcagactcccaagtagctgggaatacaggcacccgccaccacgcccggctaatttttttttttttttttttttttgtatttttagtagagacggggtttcactgtgttagccacgatggtctcgatctcctgacctcgtgatctgccgcctcggcctcccaaagtactgggattacaggcgtgagccaccgcgcccggccgacttctctttactcaggtgggtatatatgccactaatttgtttgattgtgtttttcccttgtttcattttgttttggccaagtaatatcctattgattgtatgattatcacacaattttatatccatttttctgatgggagacaggtttacttgataactactgtgcataagtaactatgaatattctcatacaattatttctgtgaagatacatacttattttcctgggtatctatagctagggatggagttgcttggtgaatgggtagaaaatgttggacagagttttgcaaagtatttgtattgctttacatttctatgaaagatgtaggccatttccagttgctctacattcccacacacttaatattttcagtcttttaaactatgccaggtgtgtagtgatatcataaaatttggttttctcatgcctaatgttcatttagatatcttcttatggaaaatatcttctcaaatttttatattcattgatatactgggctgtttgtcaatttctttgtaataggagttctttatatattttgaatgagtccatttatacatacatattttttgctgtattatatagcaaataattattcctggtctagagatagcgtttaagttgttaaacaacaacataataaggagaagctttttaaaaatgaagtgcaattcgcttgatttcttattgtggtgagtgctacagtatctagtctaagaaatattttcctgtgtcaagttcatgaaactatttcctatttttcctttacaaggtttctaattttaactttcacatcttaagataatttcaacatatgatggagagtggttaatattaactttttaaaacaacaaatattatttcactcaaaatcgttttacttaaaagtctttcatttccccaatgaagggcattggtgtctttgtttttaaaacatttagaagcggcggtgcgagcatgttctcactcatgggtgggaactgaacaatgagaacacttggacacaggacggggaacatcacacaccagggcctgtcatggggtgagggctgggggagggatagcattaggagaaatacctaatgtaaatgacgagttaatgggtgcagcaaaccaacatggcacacgtatatatatataatatatatacacgtgtatatatattatacacatatatacatgtatacacgtatacatgtatacatgtatatacgtgtatacacgtatatataatatatatacaaacacatgaatatatataatatatatacgtgtatatacatacgtgtatatatataatacgtgtatatacataatatactatatataacacgtgtatatatatattatatatatatatttttcttttttaagtggcggagcgagggctactgcacagctagcagagtcgtggcgaggaggacagcacctgcatcgagctctccgcctcccccacccgccagcccaggcggccccagcagcagtgaccagaagagcccctgcagcaacgcaacggccaggtggacacctccatctacagcctcgtggcggacgggacctgttaggacacggccattgtgggcaacaaggacccaccttccatctgggccgccgtcccagggaaaaccttcctcaacatcacgccagctgaggttggtgtcctggttggcaaagactggtcaagctttgtcatgaatgggctgacactggggggccagaaatatactgtggtcctggactcactgctgcaggatggggaattgaccacggatcttcgtatgaagagcatcggtggagcccccaccttcaacgtcattgtcaccatgactgccaagacgctaggcctgctgatgggcaaagaaggtatccatggcaatttcatcagcaagtaatgttatgaaatggcctcccaccttcagcgttcccagtactgacctgctttgttccttccactccaccgctccccacagctttgcctgcctttccttcacatacacacaccattttaatttcaggagtcattaccccacacaccttattgctgccaaaaccacatgggctgggggccagggatagatggacagacaccttcccccacccatacccctcctgtgtgtggctggaaaacttttttgttttgatggatttcttatgaataaaaaagattctactaaaaaaaatgaataactgtacatatgtgggcatattgtttgaatctgtattctttcactttgatatatttatgaatacttacaccattactactgttttaaaattactgtagctttaaaatcaggtttgaaatctagcagagtaagtcctccaacttattgcttcttcaagaccgacttgcttattctaggttctttgattttcaaatacattttgaaactagctttcaaatttctctaaaatctcctactagaaatattaatcagaattgtgttgatgtaatatgctaacaaaattgagtcttccaatcaataaacatgatatatatttatttagccttaatttttctcaccaattgcttttaggggcctcgtacctgcttcattgcatgtattgttaagcatgtaatgattctggttattaatctctattatgttttattgaatttcattttctagctgctaattgctagtatggagaaattaagatgatgaaatcaactttataaaggcataatttcggtacaacagactgcaccactttaaaatgtgtaattcaatgcacgtttacaaatggatacactaacggaactactgccacaaccaagatagaggaaattccctatgccccaaagtttcttgtacccctttgcagttcatcagcctttcaaccctcagccccaaggagccactgtcacttcaggtccgtttgcatttttaaccattttctataaatgaaatgatacctgtgttcttttgtgtctgccttctttcatgcatcaatgtaattttaaaatccatctgtaatgtctcgtaaatactgagtagtattccttcgtgtggctataccatgtatgtttgtactttcacttattattggacatttctatcattccgcgtttgggctattatgaagaaactatcatgagcatccatacgtggcaggccaggtctcactaacacaggcctccctaacaactgtttcagtaccgactgagtggttcaattaaatattaagaggaaaaaaaaaaaagaagccagtgcccttatacaaaggctggaatgtaacaaaagcccaccaagagttttgcctaggtttttcctgggccttaaagcatgacgaaataacgaaggcattcttaacaggagccatttagtattaaacgagttttattgggggtctgaagaaactccccaggcctccacaaacaagtttattggagatctgaagggactctccaaacctctgtgatttagcaggagacaagataagggcccccagcacctagacccatttagattaactgaatttaactgaggttccagaggaaggtcttcaggactcagacttatagattaaaagaagttaatcatttatgtatttagatgaatgcacacttccacatacacatatagcttagaaggtacattagctcaggaaaactttccaattttgagttggtctggtgataatttccaggccgtttccctgtaaccagttgcagaagtcaaaactctcttcctccccagttcatctgtgtctcgttacggagccacgagaaacagcatcccgcccctcaggttggtctggaaacacacatacagatcattgtgcagacacagtgtgtaaattcctaggaatggaatgactgtctatctgatttgtgttacgtttaacctttaagaaactgttagattttcaaaggagccataccatttttcattcctacaagtataagacttccaagtgctttatatcctcaccaacaggtgctattttcagcctttttaattttagccattcttatggatatgtactggtatctcattgttgcactgattgatctccctgatgactaaacagtggagcatcttttcctatgctaattgaccattcatgtatcttctttttttttttttttgagacggagtctcgctctgtcgcccaggctggagtgcagtggcgggatctcggctcactgcaagctccgcctcccgggttcacgccattctcctgcctcagcctcccaagtagctaggactacaggcgcccgccactacgcccggctattttttgtagttttagtagagacggggtttcaccgttttagccgggatggtctcgatctcctgacctcgtgatccgcccgcctcggcctcccaaagtgctgggattacaggcgtgagccaccgcgcccggccccatgtatcttcttttctgaagtatctaagtcttttgagaaattgtttcaatgtgctgtttatcttatcagactgcaatatatatatatgtgtgtgtgtgtgtgtgtgtgtgtgcctgtctgtgtatatatatatacatatatatatacgtatatatatatatacacacacatatatatacgtatatgtatatatatacgtatatatatatatatatattccctatttggagataataatcttcaaaacggtgaatatatatatgtatacacacacacacacacgtttgtgtgtgtgtgtgtgtatacatatatatatgtcctaagaatcaattagacatacatgtgagtatctatttctggattctctcttctcttccactgatatatattccatttttttttcaacaaaacacataatcttgattttcatagctgtagagtaattctggaaataggtagtgaattcattcaccattattcttttataatattgctattttattattcttgatcattgacattaccatataaatggtagaatcagcttgtaaatttctaccaaaatgccggttggaatttttattagaattgcattggatctggagatcaatttacgaagaactgactttttaaacataacaactcttctgatccatgacaaggtttatctccccactaatttagttctttcataatttctcaaagcaattttttgtagtttttggtgtactggcctactggccttacataaattttgttgactttcctttttttttttttttttttttgagacagagtcttgctctgttacccaggctggagtgcagtgatgcgatctcggctcactgtaacctctgcctcccaggttcaagtgatcctcctgcctcagcctcccaagtagctggactacaggcacatgccaccacgcctagctaattttttgtatttttagtagagatggggtttcactgtgttaggcatgatggtctccatctcctgacctcatgatctgcccacctcggcctcccaaagtgctgagattacaggtgtgagccacggtgcccagtctgttgaatttatttataaacacaacatgtatttagatgttactttaaatgaaattgtattcttatttcattttccaaatgctcatgcctttctaatttgacataaagtgctacatggcattggggctggtacagcctcgctcaattatgggttgaagagtacacagagactgccaggctgagggaaggtgcaagagaatagaagagatgctcacagagaaccacagaccgcacggccccagagtcaggggcagcatcagccactgtcggctgctcatttgtccagacagagcccacaagcctcagccatgctttgcttctgcaagatgcttcttcaccttttcaataaacctgcctgaattaaagctgatgggagtttatttctccttcatcataaaagaaattcttcaccacaacaatctccaatgaattgtgggcacagaaggcagacccatccctgcttctcttccactatctcccctgtaggttgaaaaggaggaggtactgaattacctccaaatgttcctctggctctgatattctgtgactctggtttcttttcggctactttgtttttggaagcatgtatcctaaggcgtccagttgaaaaacctttgtctactgtgtccagacattcctggtggtatttcagattaagacacccttgggttgctgcactcacaaccactgaaccaattctatgaccatctgtttcatggccacctgtttgctcattttctatgtacataaagggaggggacacaacaaatttgcatattataaactgtatcatcttaaaaaggaaacaaggcaatattttgcaataaaaccttaagatgcattaaatttaagcctaatgcagtaaagaatgcccataaaattattatctaaagaatgtttagaaaattgttgaacaagggacatcatcatttaaagtgatacgaagaaaactcagctaagcatatgggctagattagagagaaaaataaaggacccatctctgccctggaaaaactactggtagcatctttcacaaagctctctgtgtttgagtacgcaccttgatccataggctcacatttgatcccaactggcggctgcttcttggcattaactttggattcccaaccagtaaatcttaccaagatctgagtttctccaggtatgatattattttgtttgaccatccttatcttcaagggctaccaagaagaaacaaatcatttatttacctccccagaggaaaaggttttaccaatgagacactttcttaccatgaccccagggcccccatgccctgttcacttgagtgccctgtgtggcctgagagaagctcatactggtcacaggattctttatatgattaacctccttcctgaatcccaactttatggtggtggtgatgacaggtatcccatgctcatgtccctgaagtcatcagcctgtctccagttagaaaaaattacatgtatatagagaagcctctttggaagtagcaaaagctttctcaccttcatacattaatggttggaatgtacaatagtataaacactttgggaaaaaatgtctggcatattcttacagaactaaacaactacctattctatgactcactaattcctaagcatttatccaagagaaattaaaacatatgtccagaaaatgatttatacaagaatgttcatagcagttttattcataataggaaaaactggaaacattcaaatatctatcaatacaagaatggatcaataaactgtgatacattcattccatggaacggctaaaggaacaaacttttgacacacaaaacaagatggatgaatctcaaaaacattttgagtgcaataggagccatacgcaaaagagtgtgagaaaaatgataaataataatggtttcaagaaatgcagagcagagagcccagaggcaaagacccacaggacagagggtcagtcccaggctgtggatcctaactaagaaactcctgctggattttgcccagctccatttccaaactattttgggttattgacttctttatcccctccatgttccctcattttgaactagaatcactgtagtggttattctatgtctgtcccatcatttcacattaggggcagataagctgtttgttcagtttcacaggtcgacagaggtaagggaattatgtcaaggatctgcacttaatggacactctcggaagcctcattcacacctggtgtggatgttttagatgggattttaaacttttgatctgatgtggtctacatgacatttttcatgttgaactaatgctttaatgacatgaaatctggaaacctcaggggagagggtaaatgcactttgcagatgggggaatgtgagtgtcctactgtggtagatggaatttctgaaatggtccccaaacatgccacacccttgtctctaaagcctcttaaggtgatgagacaccattcctgtgactatgttgttatatgccagttatatgactttaagatggtgaggttaccgcatgaactggatctaatcacatcactccatacatgacagagctttgtgtggctggttggagaagatgaagtcagagaaggtgggagcttgagaaggactccatgagttgttattggttgaaagatgaaacagacaggtaaggaggaaagcatgtggcctctggagtcagagtagactgtctccccgctgacagccagcacagaaaaagggccctcagtcccccacaaacaagaataggaactctttcattatctgtagtgaacctggaaaaatagcttgagctctaggaaaaaaacacagccagcccattcccggattttagcctcacatgactctgatcagagaacccggccacttcattccagacttctgtggtttcaaaccactggtttgtggtaatgtgataataggcagcaagagaaaactagtacaggtgcctgtctctcctcttgaatttcaatttcagataaatgtatgctaaccctctaagagaaaaaaatcaatcaaccaatcaatgaaagaactacagtaaaaatattgccctcacctttatgtggctgttccagagcccttgccacctgaagaagacaatgaggggtatttcaggcacttgaggagtgtggctttactgttatcaatcacatttctggaagaataaaaatggttcagtgaagggatgggttgcccctccacacctgtgggcgtttctcattaggtggaaggagagacttggaaaagaaagagacacagagacaaagtacagaggaagaaaaatgggcccaggggaccggcgttcagcatacggaggacccatgccggcactggcctctgagttcccttagtatttattgatcattatcgggcatttccggagagggggatgtggcaggacaataggataatagtggagagaagatcagcaggtaaacacgtgaacaaatgtctctgcatcataaacaaggtaaagaaaaaagtgctgtgcttttgatgtgcatatacagaaacatctcaatgccttaaagagcagtattgctgccagcatgtcccacctccagtcctaaggcggttttctcctatctcagtagatggaatatacaatcgggctttacaccgagacattccattgcccagggacgagccggagacagatgccttcctcttatctcaactgcaaagaggccttccttcctcttttactaatcctcctcagcacagaccctttacgggtgtcgggctgggggacagtcaggtctttcccttcccacgaggctgtatttcagactatcacatggggagaaaccttggacaatacctggctttcctaggcagaggaccctgcagtcttccgcagtgtagtgtgcctctgggtacttgagattagggagtggtgatgactcttaacaagcatgctgccttcaagcatttgtttaacaaagcacaccctgaacagcccttaatccatttaaccctgagttgacacagcccatgtcttagggagcacagggttgggggtagggttacagattaacagcgtctcaaggcaaaacaatttttcttagtacagaacaaaatggagtctcttatgtctacttcttcctacacagacacagtaacaatctgatctctctttcttttccccacagttcaggtcaggccgtggctcgtgtctgtaatcctagcactttgagaggccaaggcaggtggatcacttgaggtcaagagttagagaccaacctggccaacatgaagaaaccctgtctctaccaaaaatacaaacattagccaggtgcggtggcaggcgcctgtaatcccagctattcaggaggctgaggcaggagaatcacttgaactcaggaggtggaggttgcagtgagctgagatggcgccgttgcatttgagcccaaggaaaagagaaataactccatctccaaaaaaaaaaagataaaataaagacggttcactacttaactccaaatattattatgtgaaaatgtatcatctcaattttaatagcagattttaaaaaattccttttcttgtgctcaccagacaaggtttggtaacaaataccagtcaccagcacagatgaaccaattcaaggagagccataaacaggactactattatgtttccccaaaaaccatccctagaatgcaatctcttctctacttgtcacaaaacgaacacaatagtccactatataaagtcccaaacacaggaaaatgtaaatataatgaaatctgctttccaaatgtttattctattcagacccagtcatggggaccagggattaggaaatgactacaaacaggttcaagggaatttgggaagtgacaaaatatgctgaagtagaactctgctgatggctgcacaattcgataaatcaacttacatcattgagttgtacattaacaatgggggacttttataacaagtaattctttaaacaaacttttgggtttctatttcaacatggaaagagctaggcagtcatcacttgtcctcacagctagaaaaaggctgaacaaactgaaagtcaacccttctagggtggatcagagaattgaggtcacagggaaaactgccaccttaaaaatgagaaacacaggctaacacacaaggagtcacagctcacagggaagagaagctactggggacagcaagtgggaggagcacttaaatggtattgacagattactagaagctgagggtagcctggctagaacattaaaaactccttgaagaccagactaagggggaatctcacacatttccaagtgttactacaatgatctcaaccaggttctcatgatgaagttcagaaaaactccctgaggtttggcactaccaacttcaggacttacattaagctacagtaacccaaatagtgtgaagttggtgaaaagagaaaacacacacatatagatgcatggaaaagaatacggagcccagaagcaggcctacatacagtccactgatcttccatggaggtttagagacaatttaaaacagcaaagatagcctttccaactagtggtgctagaacagctggacaaccacatgcaaaaaaaataaataaatccaggtatgcatgttatataccctttataaaataaatcttacacgtaaatgtaaggtgcaaaaccataagaatcctaagagataaaataggagaaaatctgagggatcctgggttcaatgatggcttcttagatacaaaaccaaaagcacaatctactaatgaaaaaaaaattaagttgagcctcattaaaattaaaaacttctgttgtgtgaaagacactgttaagagaatggaaaaagcaagtcacagactgggagaaaatatttacaaaataatctgatggaaaaactgctgccaaaatatatgaagaattctgagaactaaacaacacaaagcaaaaaaaaaaaaaaaaaaaaggtgaaagatctcaacacctcattaataagatatacagatggcaaataagcatatgagaaagatgctcaaaatcatttgttgtgagggaattgcacattaaaacaacgagatatcactgtaaacctatcagaatggctaaaacacaaaacggtgaacacaccaaatgctgtcaaagatgaggaacaaccagaactctccatagctagtggaaatcaaaagtgtacagtcactttggacaacttaagttcattcaaaatcctgcacataagtacttgcagcaattttatcataattgtcaaaacttggaagtacccaagacgtctttcaccaagtgaatgaataaacaaactgtgttgtagccatacaatgaaatctgattcagtgattttacaaaacaagctgtcaagtcatgaaaagacgtggaggaacttaaagtacataatgctagaaagaagccagtctggaaacctacatactgtaattccaactctaggacattcttggaaagtcaaaaagatagaagtagtaaaatgatgagtggttgtcaggggtggaggagaggaggaggcacgaaatggtgaagtacagggaattttcagcagtgaaactattttgcatgatgctgtattggggatttaggacattacataattgccaaaacccataatctgtgaaactcaaagaatgaactctagtgtaaactatggactttagttgataatgatgtatcaatagtggttcatcaattgtaacgaatggaccacactaatacaacatactaataggggaaactgtgtgctggaggacaggggagcctaggagaactctctgtactatccactccatttttctgtaaacctagaactgttctaaaaaataacatctattacttttttttaattaggatgcagcagccccataccaaggttttggtggcatcctgttattgtgtggttagtacttggcattgaagtgcaccaacctggagtcagagcagttggagatttcaatgcctgtgccatttacctctaaccctggggtgcccccggaacacagatagcagatcagttaggcagaagcagcctcagtcatctagacagtgcagggttctggtaaggacaggtgcaaaccatctaggtgggcagaacttggtgatgactaggaaccactgagactcagcagctgccccagtggcacccacaaatcagaggaggaggaggctgggaggacctaagggctacaggacgagctccctgcctacaagacagaagcagctccagaggttttggtaagtaatgtagatttcagtgcagtgtggtctatttaaaaaagtagaacaaaaaggaaagaaaaagagagagcatgagagacaaagaaaaagaaaagaagaaaggaagaaaggaaagaatggagggagggaaggaaggaggaagggagggaggaaggaaggaaggaagggagggagggagggagggaggcagggaggaagggaggaaggaaggaaggaaggaagggagggagggtggaagggaaggagggagggaaagaataaagagagagagaaaaagagtgggagagaagtagggaaggagagaagtagggaaggaaggaaggaaatgaacaaatttacatgaagatgagaacatccaggggaacttacaccaccagtattttccattaacaggaacacgctaactagttattggagacagacgcactactgtaaaactatatactgtttccatggggtacaaccccttcttcctcctctgaaacacataattcctctggcccactgttgccagagacactgagtcttgtctttggataagttctggtgcccaaaagaatgagatgagacagtggatcccagaacaccaggccgcaacctttcctgctgctccttgtccactccagaagctgcccagctgcaggtgggggcctcagcccctgggtctgacatcgtccatttgtcattctcactggacttccctcctcgcactggctcccactcccccaggacctggtggacggccacgtgagaaggatacaaacaggccatgcccctttctttctccccctctcaatgcctgcagtggtgggttccatggggtagtgacctgagatttactcattatggggtctctagcccagagcagggcatggtacctaatagtcaccccatgaatgctcagtgaaagaaggcgtccaccacaaggtcctggggaaccaagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcctattttgaactggcattttacagtgccgaaaggatgttggagtgtttgtatacaatgggagcaaagaagattacatctagaacatgggcaatttactggagctccttaattcactagtgtccaaagataatggttagtgggaaactgtagctgtaaaggatttgcagtctattggaatgaaaattttggtcatactactagtttaaaatttctgatagggaaaggtgttggtagaaggtaaagggagcattgataggtgatttgaaaaaatgaaaaagaggagctgactatcaacatagaacatagaccaacagcagaggcagaacctatatcagatattgtttacttgtgctgattaatgccttccttccctttatcatgctgcctgatctgaagagtactggtggaactaacattacaacctaggttccaggtaggggtatgactgagttgataccagcccaccaccatacagtggcaggtgccctttgtaagtaaggaggatagtaaatgttatcctccttactctaccattgcactgctaagtaggcttttattttgctgtatttgccacctttaaaatttatccttcgcatcgtagtcataacaagtgaggtaattaatgaggcttccttaccttcactatctttcttcacctttgacatggtaaagtttattatttctatgttattggggcatatgacatttccagcctattctgtaaccctaatccacatttggtttcagtctacagtaaaatacattcaatacttacaactttttttttttgctgtattttaccaaagcatcttcctttaattggttgttattgttttccttccttctgtaaccaaatgtattgccctttttctccacatacccatgtttttgttctctcaaaaacattaatgaaaatattttttcctgaattcttgcttgataaaaaccgcaacaaattgtaatatatcatgtctgcatagtaagactagcttggctgcacataaaaatccttggttggcattgagaatcttgttggtcttccctcatgaccatccagcttcagtacagctaggggagccaggacagccttcttcatttctcctgtgagtgacttattctttttttctggctgcccaatagataccttattttttttaagtccaataccttcattaagatgtggttcactttttgcctgtcatgaatggatataccttgcttctgatgtgcccttttgaaaggtagattcaagtcttcatgcattgcatggaagtgttcttgaattataattttgaagtatttgttctgtctcttttggtttcttctttggatgttccagtaatgtatgtgttcaatccatttgtcggtcttccatagttctcattttctctgtaatacttgagttttgcttttcagatgtttgcttagataatttttgtataaatgggtatctatttccttttatttttgtaatatactactaaatggtttgggttttcctagataactacagaggttcagagagagaattaagacaaccttctgggcctcacaccagaatggctctttcctactgggctgtcacagagacagactgcttcctgcaagtatggctcctctggtgattctctgtgtggttgaatctcccttgttcctcccttgaacaaaactgggtccaggaggggactttttctggtagactgtgtaccctggttcccactcctgtggttaaaaaaaaggggtataagttttgaacatggaaatgaactcccaaattttcagggagtacattttgttggtgttttctgagattatcagccattggcctcactacctccatacttcatttactcccatgtggcttgtgcctgattccaactagatttagtcatccctacataagttttgaaatctttggattctaactttttctagtttcactaaggatatatttggttctttttttctccattttccttgttgcttttttatgtgttctggaataacatgaggaaaaatgctgacttttacagcctgtgtatacaactacctctacagaaaattttaagatatatattagttctttatattcacacaataactttgcaaatagtcctagtgtacaaagcttattccgatatcttgctgtgtttttaaacaaacatatatacatatatgctgtgatagctgatgttgagtgtcaacctgattggattgaaggatgcaaaatattgttcctgggcatgtctgtgagggtgttgccaaaggagattaacatttaagtcagtggattgggagaggcagaccctccttctatctgggtgggcaccatctaatcagctgtcagcacagctagaataaagcaggcagaagaagatggaagaacagacttgctgagtcttctggctttcatctttctcctgtgctggaagtatcctggtctcgaacatcagactccaagttcttcagcttttagactcttggacttacaccagtgatttttcaggggctctcgggcctttggccacagactgaagactgcattgtttacttcccaactttcgaggtttcgggactcagactgatgcaccactggcttccttgctcctcaacgtgcagatggcctatcatgggaatttatcttgtaatcatgtgagttgattctctttaataaacccccttttatatgtacatctattctatcagttctgtccctctagagaaccctgactaatacacatgcatacacacatgtggtcatgcagacatgtatacatgcatgcacacatatgtgaccacatgaacatgcatacacatatgtgatctttgccattgtggatggctaggatgatttttctcaggaaaggtatctgtgttattagaaaaatagccctggttctcatcctaaagtcataaaaatcaggaggtaactcagtaaaaggagacacacacacacacacacgatgttatatgtataagtgatttaatattttatatatataatcaaatccttgaaattgccctttgtattaatcagtgttctttatagaaacagaatcaagagtatatgtgtgcatgtgcacgcatgtgtgtgtgtgtgtgtatatatatacacatatatatttaatacgtgtgtgtgtgtgtatatatatatatagacagagagagagggaaagaaggagagagagggagtttattataagaaattggctcatgtgattatgggggctgaaagtctcacaatctgccatctgcagctggagacccaggaaagacagtgatgtagttgagagaaccaaagtatcgatggtataagacccagtcaagaacagcacagggggctgatgtgtcagctcaagcagttaggcagagggtgaagtcacccttcctgtgctttctgttctattcgggtctcaatgaatcggataatgcccactcacacggtggagggccacctgctttactcagtctgctgattcaaacgctaatctcatacagaaacagcttcacaggcataaccaggacccatgtttagtctgggcacctcatgtctaagtgaatttgacacaaaaattatccatcatacccagagttcttaatcaaagtttcaatgactgaggccagtcctgggcagctaatgttcgtccaatattgcgtctagttttaccatcccttccgtttgccagaaatagaaacagaaaatgttctacatgtttgcaccaccaaataatgaataagcaatcaaatgccattttgattattgaccttctagcttttacaaaacacaaaacttgcacaaataaagatactattggaagccaaggaacctagagacacatgtaaattctctttatctctgctcgatgcgtaaagtattcttatttaagagtaaatttcctcttgtttcagtgaaagatatttttaactgatatttttaccttcagcaaacacataaacggtgaaagttatcccaaacattgccattttcaatttccaaaggagcttatgctaatttcagaggcatctctatggtttatatgtatatttaatatataaggcaggtcctactatctctattttacagaagaagaaactgaagttggaaagatcaacaagcttacctgaagtcacagggcgggagagtaaaggagcagaattttcaacctaagtttatatgattctaaaattttccactaccatgctactaaaagaaattactcaactagttcttcctgttcaggtaagtcagttcagactttgctaattctgaataaaggggacagaagttatgatgctgtaactatttgacatagactgtgttagattagagatgagaggcaaaaatctgaccctagtatatttgctttcattgattccaatgtcatctttaggtttttgtatatttctttctgattttaacatatgatcctttattttcttcttactttcctcccttcctcctctctctgtcaaattgttttcctcttcctcctcttttaaaaattctcaaaatttgactataaattgctttttcttctttgctccttttcacaactctttcattgccacaaggcattcaggtagaaaaaaaggccaaggtagtctgcagtgggctagctatttacccaattgacccaccatatcttttacataagcaaataaattaacaagttatgtaaataatttatattcaaatattcagaaatgtcttagacatgtttaacatgctaccagtaaactccttttaggaggagaccacatgcagctttagaatagaaaatagaagaaaggaaaaaaataaacaaatgaaggtttttctctgcagtctttatgcaagcaacgacttatttcttaaactctcccctttgtggctatcactcaaagaaaataaagaagaaaagctactggctttctagtttaaatcacagtctcattattctgtaggtgaatggggagggggattggaatcgtaggtccgagtgggcagtaacttgaagtcaatggagatatttacaaaacagaagcacaatcacgatccagcagttctggagctgctaactttttctgcctttttctaaatgtccaataataaggttctaatggagactgaagatccatcacctgctccacatctccagggggcccatgtgtgcatcgcagtgcagatcatacatgcttctttcccctcccatggcaaggggaatactgaatgatgacaactcacatgtgtaacccaagggctttgcttgggtttgcaaggactagtgcacaatacattctttgagtgttataataacattaagtcaatgcacgaattataatccctatttcacaagtacaaaaacacattcaaagaaattaacttccttgctcaccaaacagttattgacaaaaattacaatatttatgtttcttttgaaaaatattataaagattctcaaattgtctaaccaatcatattatccgtatttgtctcttctcaagctgttaataaagacatacccaagactgggacatttataaaggaaaaaggtttaattgactcacagttcggcatggctgtggaggcctcaggaaacttacaatcatggtagaaggggaagcaaatatgtcctttttcacatggcggcagcaaagagaggtgggaaaaaggagggaaaagccccttataaaaccatcagatctcatgaaaactcacttactatcaggagaacagcatggaggtaactgctcccatgataaaatcaccttccaccaggtccctcccatgtcaggtggggattatgggaactacagctcaagatgagatttgggtggagacgtagccaaacatatcgttatcttgataagatattgctttggattgaatcgtgtccctgcaaaaatcttatgtataaaagttctgatccctgatgtgactgtttttgaagacaggcagggcctttagtaggcacttaaggtcaaattaggtcatacgggtgggacctcagtctactaggactggtggctttatactgaaagaaagagacagatgtctctcccctcgacctcacatgtataaaggccacataaggaaaaagcagcccaagccggtaagaggccccaacagacgccaaacccttccagcttcatgatcttggacttcactgcccccaaaactgtaagagaatgaaattctgctgcttatgccatccagtctgtggcatttagttacgccagcctgcactggctaatgcagatattcagaatcaaatgagtcatcccaagcaatttctcagtatatacagcacagatttcaccttctaaactcacccttgtcttcgcctttttttttttttttttgagacggagtctcactctatctcccaggctggagtgcagtggcgctatctcggctcactgcaagctccgcctcccgggttcaccccattctcctgcctgagcgtcccgagtagctgggactacaggcgcccgccaccacgcctgactagtttttttttttttaatatttatatttttagtagagatggggtttcaccgtgttagccaggatggtctcaatctgctgacctcgtgatctgcccgcctcggcctcccaaagtgctggaactacaggcatgagccaccacacctggccagtttttcttaattattaaataatctttcactgatttaagaaatattttcatatggttcctattcaggcccaggcattgtttttttgtgctgcagacaatgtgttaataaaagctgtccagccttgttagtacatcatgatatttatatttgacaaatcctctacttagatatgtatcacctccataattttttggaacacataaattttttgaaccaaatggaataaaaagctagatatatacgtataatgaatatatttgaaactttgtactttgctttacaatttgcaaaagaacatcatatacagtgttgtatttgagtctcccttaagccctattaagaagaaatttttctatttctgctgttcagtgaagaaaatgagcaaaaaaaggtgcagcaacttcccaatatcccatatttacaaacataaaggagtgggactttaaggtagactcttggtgtccacgtttgtgctctttatgcttcatgacaccaggtaaagtgcaatgagcacagcaaatgtgccccctcaggagccagctaagaccttccgggggcttctcctggaagtacagagtctgcgacccccatcctaaatacacaagcattggcatcactgcctcacagtaaaacaaaacaaaacaaaacaaacaaacaaaacaacaaagaaaaaaacaaatacaatctgttcagcagagtaattgtacataacacaaaagaacttctgggaaaaacacggaaaggatattgaagtcagaggctcagtcatgtgaaaataaaaggtcttgttgggtgcctaagtcttgtctttgctaacagctgttttcgtgcaataccagtaaacccagccaaaggcattctagtgagcaacacaggaagactcctatacacttcaattttccagcaatccataaaattgaaacataaaaataggattctatttcccttgttcattctatatcttaccagaacttatatttgcatatgtgtagaaactcaaggtttacaaagcatatccacggtctttattgtatttgatgctccacaaaatgttgcaagggactcagacaaagtcttgtttgtactatgttacaggtgagaatgctgacatgtagaggggcaagtacttacctgatcacgttgtcttagtatgatgaagcctcacttaaacccatgatctcatgtcttcccttaaactgatgcactgaaatacagtcaggtaaaataaagagttaggggcacattttaaaatacatttaaggtgcatcaaagatttaaaccaatcacttgtaacatctctatttgtcaaactcattggtgatcattagcatttagagagacccaggaaaatcgcaagattctaaataattttcaaaccatagtagaggatactttgtttactgttatttatgtattaaatatcttttaatatactatagctttataagaacagataatccatttttggaatttgtgttttaattggccaaagagttaaatccattttttctagatcctctggataattaggaatcggtagtaaaaagcaattgcacttttccaataaaataatatgctcagttgttcaaacccacattcttgataaaaacaactagaaattctgcataagatagaagaaaaagaagattttggagcaacaaagagcatacaagatggtaaggaattacaagaccaaaatctaagtgatgtcttgatctcagaaaagaaagctaaatgttgaattccctttggcccttggagaattcatgaaagcagtgaatttgagcttcagtttttcagtctctgtggagtgatatggaagaaggaaaaaatctcaagtccccagcaacacgcatgtgataatagaagactttccccctatgaaacaagacctccaaagagctataatttcacaataagcataaaccaaaagtaaacccacactacctcactcctgcttccatgtgtcggcaaggaagtgttcgttggtgctaaacaaagcatggggaaaatgctgctgttgcataaattacaatctcaaaaactcaagctataaatttagtttaaaacagttcacaatacctaatagaaacaaatgtgcagttcctcctcatcctgaaagaatctccacaataatattccaaggaaaataatgcactcacagcgtatgtatgtatcacctatatgatgtatatagctgatagataagtacatatgtatcatatatatatatacatataaccattacagagaactagaagaaatagtggagaaagaaacagttctacaaagaccctagatttaaaaataatcagagaaaaatgttgtaaaacagctcttctcataacgtccaaagctagaacacacttgaaacaatctcagcaaaagaaagctgtcaaatatgcagccataaaaaaggatgagttcatgtcctttgtagggacatagatgaagctggaaaccatcattctcagcaaactatcgcaaggacagaaaaccaaacacggcatgttcttactcataggtgggtactgaacaatgagaacacttggacacagaaaggggaacatcacacaccaggagctgtcgttgggtagggggaggggggagggataccattaggagatatacctaatgtaaatgacaagttaatgggtgcagcacgacaacatggcacatgtatacatatgtaacaaatctgcacgttgtgcacatgtaccctagaacttaaagtataataataataataataacaataataataaaagaaagctgttaaaaatgaccagcatagaatctctcttccccactgtcagacaacatttcagtggtccctgtaactattgctctggtcctgaataaaatctttctcgccatgcttgaaaaaaaaaaaaaacagaattgcaaaatatgtctctgacaaaggactaatatcaagaatctacaaggacctcaaagaattcaagaagagaaaaagaaacaaccccattaaaaactgggcaaaggacatgaacagacatttttcaaaaaaaaaatgcaagcagccaacaaacacaggaaaaaatgctcagaatcactaatcattaaagaaatgctcattaaaaccacaatgagatatcatcttagtcagaatggctgttattaaaaagttgaaaaaagaaaaaaacagaggttgacttggatgcagagcaaagagagaatgcttatacactattggtgggaatataaattagttcaagctctatggaaaacagtatgaagatatctcaaagaactgaaaacagaactaccctttgacccagaaatattcataactggacacctacccaaaggaaaacaaatcattataggacaataccatgacaatagcaaagtcacggaaccaacctaagtctaacctatgggtccatcaataattgattggataaagaaaatgtgatatatatacacatcatgtaatactacaccaccataaaaaagaatgaaatcatgtcctttgaagcaacatggatggaggtgtagaccattattctaagtgaattaactcagaaacagaaaataaaatactgcatattctcacatacaagtggaagctaaacaattggtacacatgggcataaagatggaaataatagacactgaggtttcccaaaggggagaggatgtgagtgttgaaaaactacctattaggtacaatattcattatttgggtaatgggtgaactagaagcccaatccccaccagtatgcaatatacccatttaacaaacattcacatggaccccttgaatctaaaataaaataaatattttttaaatgactggaatgtgtgaaaaaggaaacaaagaacatttctaaaatagaaagatgcaaaaaataaatttttaaatgcaatggctgttcactattttgtagtagctaaagtaggtactagtgaatccaaagatcagtcagaagaaattatgcagaatgcatcacagcaaaacagaggcagtgagacattttaccatatttttacttggattcctaaacaaagaggagaaagaacatagaacagagaaaacgtttgtaagtaatattttaagataatgactgataccctacatcaaaagaaagccaacgggaagttcctaaatctatagagggtacacaaacataaaactacacttgaacatgtcatggcgagttggacgaaccaaaaacaatagtaaaaccaaagaacaaccacacacatgcataaatccacaaggtagtgaataaaatagcttactttcaaggcagcagaatggcattgaccactaactactcaacagaaatgatgaaagacggatgccagaagaatgagatcaccaaagtgctaataaaaaataattgccaacctagaatttctaggacccactttttaagagtaggatgaaatgcagacattcttgggcaaacaaaaaaagagagtttatctgcagtatatcctcagaaaaggatgtaattaaatcagagaaaaagatgaggatcaagaaggtaggaaacatgcaaaaatcatgacaagtagtttttgccattaagaaaaagatgaaactaattaattccacaaaacaagtcaagaataactcgtgaattagagggagcagaaatggagttgccatcttcaaaggcactcgttttcaggagatgtatacaatttttggaaaaacttgtatttgaaaagttaagtatgcattttgcaattttcagagagtgaaagaatagcaacaaaatacttataaactaggaaaggaaaaatcttgaataagaaaataatctataccaaaaaagccatatttaagtactatgtttattttgttaaattaatttaaattttaaaaaattatcttcactctatgcaataatatttgtgaaattttgactctggtgtgtaaattaacttgtttactgcattgaatcctttgtcatttttgtaatactttgattatctccatctaaatattcaaacatcacctcttaacataaccagtggtacactttccatgatttagatatggtggtctgactagcgttgaaacttgagagaagctagcctcaataacaggacccagggataaccatctagttctccagcgaagggccttaagccttctgggggtccacattgttggttactcactaatcaaagatgtacccggcccctagttttctcctccctgactcaagttcatgtcattcaactctctgcctggttcacggactcatggtattctgccctactcctgctgcttggctatccaccagttaccaaaagctgaagctgatgcaaccacgtgaaatttctacaagaccctcccctctttgggctcccatcacattatcactactgccagatgtcatcagcgtgagagaatcagtggtggtccacaggagcatcttgttgtccctccctaaatgataccagcaccactttcctcccaaaatcaatgctcccaaccacaataccccccttgacttcacttgtgttcccagcaagccatcaaaactagcaccaaggctctctctaggaggctataaatatgtatgttttccttttttctgtctttaaatggtgagttaacacaaacagacctacgtacaccagaccccaaggtatcaatctggatcccttcacaggatccttttccattcacagaaccaagaaaaaaaagcaaactctgaagcccagcccttccctcctctattccggagcaggcagctgatgggacgcaaatggggctgctgagcttcagggtggaaatggaagccagtgccttgtgctccttgtgatgtgaaaagtgttgcagctgcgcagagaaacaagagttttcactggacacagtgcaaggagcaagcaggatgcctttcatggacagaagctgcatctgtctatacttcagccattcaatcaacaaacatttcatgatcatcagttactgctatgaaaggtagatgctgagggtaaaacaaggaacaagatgagaatgccccactcccatatggcacatgtaaaagcataaaagtctatctgaatcatttttgaaacagaaggcccatgacattgcctgctgagtccacattggctcttgtttgtggataccagcacatattaaaattatctgaaatattcagttgtgagccccctcccctgatatggttaggcttcacgtccccacccagatctcatcttgaattgtaatccccataatccccataatccctatttgtcaaaggagagaccaggtggaggtaattgaatcatggggatggtttcccccatgctgttctcatgatagtgagtgagttctcccaagatcggatggttttataaggggcttcttcccctttgcttagcacttctcctttctgccaccttgtgtagaaggtgccttgcttccccttcaccttccaccatgattgtaagtttcctgaggcctccccagccgtgctgaactgtgagtcaattaaacctctttcttttataaattacccagtctcaggcagttctttattacagtatgaaaatggactaatacagtgagaaaaaaaatagctctggagggctgggttacattcaggacatgtactaaatattttaatgcatttttttagcaagcacgtaaaatgtctcccccaaggctttaagctctctttctacttccctaaaggtttccccatcaaaataggaaataaatattgaagctagaaaaggcttgtccccttcaaagtaagtaagggcacgcttcatgacaggcatatctttcttcagacagtgggggaggacacttaattccttcacctaagaaaaaaaaagttacaaaacagcaacctatggaaacaaaaacatggaatcaatgcatcgcctgaaataacttccctgtagtcctgagggtggtgttttgtttggcttgttctccttcccacctttttataccccccaaggatccttctcattctgttgtagccagggctcctagagaaggctgtcaacattgaagggcccagatcccttctaccagtttttcttgtgcttcctatgtgcttgtaactgtgaatctcctgcttttcaaacaactcttctgccttttgtatgggtatacattaaaggggaaaatcagggcctcttcacactactctggcaaaatcaacctgaactgctggattataggtcttggcatctggagctgcctgcttgagccctggcaggtctggaggcttggggctctttcattgactcaggaaatatttctgcttcccacccaggacttctgttgtctcttcctcccttctcctgccctgctctcaggactcttagatgtagcccaggtttgcttccacacagttgacattggcggtgcacggtcttctcccctctacgccctcagatctccacgcctgtgcctatgacacgtgccacctgcaccggtgttgccaagcctggctcctcatccgtggccactcctgcccccacaacctgccagtcctgcctcctttttgcctgcctcctgcctatctttacttcactgatttctttggctggaaaatatttctacaacttcccctcccacactcacctggggctatgacattgttgtgggcactggttgggcctcgcccctaccacctaacaagtacatcctacaggcccaggagggcattatctgtggttttgaatttctagtgtctcgaactgtactggcccagagaggacctcaaatatggaaaactgaagtgattgctttctgcacgcgttacctatgcacccatgcataactcacacaaacttactgaatcttcatttactcttctgtgaaaggggagtaatcaaagaaatgcactttactaacaacaagaggatggcatagtttatcttttaaactgataaagatgttctgaaataagaatctatgttttcaagggtacaggactttggtagttacaccatgacagtaaagatgcatattttaggaacttggtgggggataatttgacaatacacatctacatgtttacattgtacataccctttgactgacactccactgttagaaatttgtactaaggaaataatcagacctacaacataagcacttagctataggaatactggccaaagagttgttgatcatactcaaaaattagaaacaatctaaatatgcaataagaaatatttaaaataaattatattgcattcatctgatgtaatattatacagacatttagaaagctcttgtagtcaaaggataagtaggttacctttggcatattaaatgagtaaaactgatactaagttgatatacccattgtgatataattttctttggttcttaaatatttttatatacctaaggaaaaagattaaaagcttatgaaaccaaaatattcacagtttagttatcacagtctagtgtgattatgggtaatttttattgttttaatttcatatttttctgttcaaagttccatcgcttgtttaattaaaaaaaacttttaaataatattataaaatgaccatcacagaaaaaaatatcattaggcaatattgccatgactatagacctttctccctacactgttattcttacagttggatgctttgaatcgggaagtgatatatcgccttgcttttcactggagaaggaagcgccagcctttgtgagcatgtgtatcacaagctaactagcacgaagattgcatagctctttctacataaggctactgttcgcagaaatttggtccatggtctccagtctcttggggtctcacgctctgtgaaaatcttcgtgtttttccctagcccccagagtcacctttcacacagcgtctgcttgtaaccgcggtccccacaggagtttgtaggatttctgtgccagcggtgaaggtgttctcaccttatagagcaaggtagaaactacgcagacaggcgctgttctttgggatgaaagcagggcctttggggctctttcttagtgtccccgttcggttgtagacataacacgcttgctttgtgtaggagatcggctctgccggcgcccaggggccctaacgcaattcatcgagacccgcaggtcagaactgcagtctcacctgtcttggcggaaatgcgctgcgctcctccctgtactacataagcacgagaattccactacagaagaaaaccccaggcctagtgatggcggttctgggcattttgccagcttctcccagggtgtgttttctgaccccacccacttctgatctgtaatgtcatggtcaatagaaactacttggcccaaacggaaaaggcaaggaggaacacagcgggaaagcctatggcgttccctggtggctaccccggggactgcactcatagatccgcgtgttccgagaagcctctgccatcccgaccccggagccgtgcagaaacccgcggctccaaagaaaaccggctagaacgcacaggaagcccagccagtgttcaggacactgcgagtggaagccgtacgtcccacggactgatctagtttgctgaagacgagccatttacttctaaccccagcagcggacattgccttgctcaaatataaaatatatgaaccaagaccgaaagcaactcttattgcgttactgatgagcaaacgggtttttagaatggttaagaaatgtcccttgttttgggaccgtcatcactaacgtatgcttgggattcctgatcgaggagcttctgagcaaagcagcccaccaatccagtggctgagaacggcttggatattggcttccaggcgcatcagaaatactgaggttctgacaaagacgtgagcttctgtctgcctttgggaaggccttcttccagtcctggcgctgccgcttgccttctgtttgacctgggaccaggtccttcaatttgctaggcttcaagttggaaagtgttacaggaaaataataatacgaagtacttcttagagttattgcacagattacagaagatagtctaatagtacagctagcatcctgtatggcttacattaaggatttgctgataggaaacaacatcccagataaagttttttccccttaattatgaaatataacaaaggaaattgtgtagacttatgcttcaggcctctgtaacatttgaatgaattttgcacttgtgaaggtgacatcattttacaaaatcagttaatactaaagaatgacaagtggaatttacaaaacatatattcacaaaaagaacttgttcttagcagctttgtttacaatagtccccaaactggaaaaggttcatatgcatcaagaggtgaatggacctattgtgatatattcatccaacggagtactaccctcaataagatgggacaaattatggaaacatgagatagcatgggccaatctcaaaaacctcatgctgagtgatgaaaagagtgcattctatgtggtgccatcaagatgaatttctagaacatgtgaaactaacctgtatagtggcagaaaatacatcattaattgctggggtcagggagtcgaggggactgactgcaaagggcacaagaggaccttctggagtagtagacatgtcatcaaacttgaaatggatgcagtgtaccatattcaaccaatgccttaatcaatttgattgtaaaaagtagtaagaaaaccactgcaggctggacgcggtggctcacgcctgtaatcctagcactttgggaggctgaggcaggcggatgggaggcggaggtcgcagtgagacgagatcgagccactgcacttcagcctgggcaacagagccaaaaaaaaaaaaaaaaaaaaaaaaacctccgtctcaaaaaaaataaaaaaaaaaaaacacagcaaatcataatgcattctacttaatttaatgtatgtttagctttagaggattcctttagaaaagcgtctcgctaaatgtgattgagagttcaggaattccttcatttctgtttctgtctctttgtcttcagttaaattcatgcactattaaatggaatatttgtaaaataaaaatagagtctaagttcaattttacaaaagcatatatataatatacagctcccatatatatgtgtgtgtatatatagagagagctttatttattgtttgttttttcttttgcgggggtgcgggggggacagtctagctaaaatatacattcttctctctgtagatataccagaagaacatgactcgatcagtgttgccctaatgttaacaaaagttattttgaacttaaggtgatcagaaattttacctatctgtactttttctgtattggtggtatggtctatgctaagcgtgtataattaaaaaaaaagagagtaacttcaaaatgatttggaagaaaaaatatgtacatatgtgaatagtacttaattccaggtgatgggaatatggatgactggttatcttcttctttctgtatcttttatatttttaaatggaaaaactcaacgacctggaagtgaaagaacagatttggaagaggtgtggggcaggtgagaggaaaatgcagagtgaaactctgtctcaaaaaaaaaaaaaagttacttgtaataaaactcaccaattttaaatctacgatgtaaccatttaaggaggtttgtagaattgtgcagccatcagcagagtcacgttttagaatatttttgtcatttccccaaataccctaaagcctctgcacagtcatttcctaatctctggtgcccatgactgggccccaacaaaataaaaatttggaaatccgacatcattaaatttcaaattttcttagattgggattttttgtagtgaatcattgtcttacttttgtgacatttgaggaaatattgcattttagggacttttttgatgaacttaatagtcctgttcattgctcttcgtgaattgtttcatttttaccgataactgatagttgctaccaaacctggtctggcaagcctaaatgaatgagctaaaaaagaaaaaaatctgctataagaaatagagatagatgatgaatttgcacataagattatgtggagttagtattgtaccatctttattctttcagaaatttggttggtaacattagagatactcctcacatgcttggaatgcctctcattatcttcttcaggttgcaagggctccagaatagtgacataaaggtgaacgtgagtgcaagatttttgctgtagttctttgctctttaatttttttctcttagagggattagcttccatgtatctgaaataataaatcaagagtagagataggcatctgtaccagttttctattgctgcctattaacacatgcaacaaactagtggattgaaaccacagaagtctggaacagaggctgagttctctgataagggttttaggaagctgaatccaggtgtgtctggctatgtagttacgtggagctcaggctacttctccaatttcacttcaggtataggaggaattcattttgtgggagttgaaagactggtttttctttttctgtgctggctgtcccaataacagctcatggagtccttctcaagctcccattcttcctgacgttaccttcttctgacagctagagaaaccactggcatgtatgcagtgatgtgattagatccagtttacacaggtaacctcaccatcttaaagtcgtataactggcttataacaacataatcaccagaatgatgtctcagcaccttaacaggctttagagacaagggtgtggcatgtttggggaccatttcagaaattccatctaccgcagttggacactcacattcccccatctgcaaaatacattcaccctctcccctaaggtttccaaatttcatgtcattaaagcgttagttcaaagtgaaaaatggtatgtagaccacaccagatcaaaaatttaaaatcttatcttaatcatccacaccaagtatgaatgaggcttctgagggtgtccttgacataattcccttccctctatcaacctgtgaaactgaacaaacagcttatctgccctcagtgtgcaatggtgggacagacatagaaaaacgattctttttttttaaaatttttttattatactttaagttttagggtacatgtgcacaatgtgcaggttagctacatatgtatacatgtgccatgctggtgtgctgcacccattaactcatcatttagcattaggtatatctcctaatgctatccctcccccctcctagaaaaacaattctagtgattcttgttcacaaacggggaaagtggaagtaacaaagaagtcactgatccaaaacctttttgaaatggggctgagcaaagtccagcaggaattgcgtggttaggatccacaacctggaactaaccttctgtgacatggggctttgcctctggagtctgcatttctttctatctttatggcaatcattttattttccttcctctcctactcccttggttcttcccctttctccttatggcagcatcctccccttaatccttggcacatcatccccagcagaattggtcaaatgttgcccacgtcacggtcctgaccatctccatgaggggctgtccttgtgaccccctgctcccctgggaccctcttcactgacctgacctctctgtcatgattgctttcagctgacctggctggtttaggagaaaacctagaattgtggagacccagaaccaatctctgccctctcttatctccaagagaggaagaaaataataggtatcaccatggagaaatgacccacatgagggctgagactctccagcagttagagcagaggaaactccctgaagaagggaggagctgagatcccaggctgggagagcaggcttgtgttaagcattacttaatctttaattgctccctgcctgaatctaccagccagcgaatgacaactgactgagtataaatactaggactacagaaccgtgataaaaggtttgtccaaggaaaagcccttttactttatttgttttcacagtggaaattgctgtttttgatccaaagttttctgaaacgcagcagtgagttcctggtgggtgagttaggtgctttggacctggaggctgaggccaaggcttgtgtggtcgatctgctgccaccatgtggtgagggagcctgggagagtcttagtctttcttggcttcactttcctcctcagtgaggtaggggcttattgttcctctctgaggtcgcttcctactgtgttttctctgagtctctgaggaactgagatggtttttatttatttatttttttccttccctttccctccttctttcgtgtgcccagctgccaatcaagccacccacctttccatttgctggggaagggggcggtacccaaccccctctattactagggggttgttatggtaactccccacgcgagggctgggtggcctctagataggacgggctgtccacccacccaattgctatggcaacagtggagccgctgagggaggggccactccgtgagaacttggctggagaaaccacgtgggagttggggggcagaggaggggcaccggctgcctcaggaatgccctttccaccctcacctagcaggttggggaagcatcgaggtgctctcagatctcaggataaggaatcctaccgcagacgtgtatctctgcacctcttttaacgaagtgttctgcacaaaggaactgtttccacaattattcattgatcactggagtcgcgcgtggaggaaggggtggcgaaggggaagagagggaatctgcgttcagtcccttaaaatattgcttgggtcgccttagatctagtcatgttggcatagcgcctacagccattagcctcagtggaggctgggtaatgctatctaagaaccacgagtcatgttctaccgctgaaatgctgtgtgaccttgagcaagttgctttgcttctctgaggttttctttcactgtgaaattgaggggggaggctgtatgatcctcaagagctcttctagcaccaacactgcctctgaaagactccaccaccagccttaatataaacatcatttaagagagtttaatttagaagtccttgaaaaatagctgaacacattcctttctggaccctttttagcatttgggtgcacagccagtcggcccccttccctaacccctagcccattttccttgccactgcccttattccagccgctatccccattcatctcctatttggccttccggcctgactccttcaagtcaattctttttttttttttcttttttcttttttttttttttttttttgagacagagtctcactccatcgcccaggctggagtgcagtggcgcgatcttagctcactgcaagctccgctttccgggttcacgccattctcctgcctcagcctcccgagcagctgggactacaggcgcccgccacctcgcccggctaattttttgtattttttattggagacggggtttcaccatgttagccaggatggtctcgatctcatgacctcgtgatccgcccgcctcggcctcccaaagtgctgggattacaggcgtcagccactgtgcccagcctctatttttttttttaaagaaaaagtctcgctctgtcacccaggctggagtacaatggtatgatctctgctcactgcaacctcaagcttcccggcccaagctatcctccagcctcagcctcccaagtagccaggaccacaggcagtgcatgccaccacgcctggctgattcttatatgttttgtagagatggggctttgccatgtcgcccaatctggtctcaaacctctggccccaagtgatctgcccgcctcggcctcccaaaatggggagattacaggatcccttgaggacaggagttggaggccagcctggccaacatggtggggttttttttttttttttttttttttgagacagttttagtttagtttagttttttgtgaatttgtgaatttgtttttattggggaacaggacacagggtggaaaatgtcaccttggtggagacagagttttgttctcattgcccaggctggagtgcagtggcacaatcccggcccaccgcaacctccacctcccgggttcaagcaactctcctatctcagcctcccgagtagctgggactacaggtgcacgccaccacgcccagccaatcctttgcattttcagttgagatggggtctcaccatgttggccaggctggtctcgaactccccatctcaggcgatccacctgcatcggcctcccaaagtgcagggatcacaggcgtgaaccaccacaaccggccaagcctggcagacatggtgaaactctgctgagatggtttttaatgccacccaggacctgcagctgagacctgactctgtgtgtctcctgcaggagcctgagctgagtccacacactggaagcccagaactgagggaacagatgaaagaaagaaagtcagcaggtttaggggatgagaacaactcacaaaggacaagccattggtaaatgaaaaccaaagaaggggggaataaggacaagttgggatagaagcctcaggggaaatgggcaatgcctgtcatcatccaaactctcaaggagcagcgcgagctgagcagtggggactgagagagaaatttactccacaggagtctcctgcccctggccagggagagccacaggctggatgacatctggtttatagtgaggggcagcagcaactccaagagggggaagatgtgaccatgagccccgccccagacccaggaggcttgaccttggggctgccgtagcagtggatgctcttcaggtcagtgtgggttagagggaataaccatgctgggagaagggttggagacatccattcttatgttaaaaagctctgccctaggtcaggtgctagagtaagtgtcccttgctagtatacaaagcagtgatacttataatattcttctgtacttacagttgaaggaggtttccaaatgatatctcataaatatttattggtgtttaattttctttacgctgtgttaaacacttgggattcagatattaatgtctccccaaaggaactcaagcccatgagagaaagaacagaaatatagctttttaagaaaatatgaaagttcccccacattggggtgctgtggcaacccatagagtgggagtttaagtgaagacattgctcctaatgacagggggaatcataagaggacttcttcagaacagactcattttcctccaatgtcccacagagagggatcctggggcatgaatggtgtaaggcaagggccagtctaaggaaagggatttgctgcatcctgggagaaatctcagcctccctgacaggatatttgggacaggaatgcaggtgagaggaggtttgcaatcgcttttattcaataattgatgaacactctcctgagaactcccttagtgctagaccctgagctgggaaccatgaacacagagattagcaagatatgatctcagctttgacagaactctcagtctagtgaccagcgattcctgagaagtatggtgatggtgggttcactggaaccagtggcccatgctgcatggagatgacctcagtggatggcctggtctctcttctgtttttttcaaatagctgaatgacctatcctgggcccgtgaccctggacttcagccagatcagcatctcaaggtacaaccaacatcttggctccatgatgggtcaaaacagttaacacacccaaggtattcaaggtatcagtagctactgactatgtcctggccagctgtgaaaagaaaggggtgaatttaacaagtattctaaaattgtccttgacatagtaatcacagattatctatcttctgtctggtaatatatatatatatatatatgtttttgtttttgttgttgttgttttgtttttttgtgacggagtttcgctctttttacccaggctggagttcaatggcatgatctcggctcactgcaacctctgcctctgggttcaagtgattctcctgcctcagcctcctgagtagctgggattacaggtgtgtgccaccacgcccggctaatttcctatatttttagtagagacgggttttcaccacgtcggccaggctggtttcgaactcctgacttcaggtgatccacccacctcggcctcccaaagtgctgggattacaggcgtgagccaccactcccagcctctgtctggtaatttaaatgctttggagactccaagattcacccatgtccaaaataaattctatatcagtcatagtactagcatttagaagttgtgtgttttatcctctaattatagatgaaatacctaaggtggaaaggagtaaagcagcttccatgaatgtagtgagaatgtaggggggttagggactaaagtcctgccttaggattccccagcagttgccagtcacaatttttgtactcttagaaacaacaacaacaacaacaaaatgacaacctgttttgttcctctgcttaccctatccaattctctacaccataacatctctgcttatcaagacaacttggattctcaatttgttgagctcaacaaatgcatctcttgagcccctgtgggtaaagcattatgctagttatggcgggtgatacagaggaagcacagaagagtccttagtgacaagagcttaagatttctgctctcagctcagcctgagttgcctgcaggtgagaaaatcagtagccgacacccacaggtgcattctggtgaaagggtcgatgataatgaatagtggttctgacagggctgggctcttaacctcccaaagatgctggtcaaacagaatctggaggatctctgcacatagtgtctgactactgactgtcataagtgaatgtcgccaagtcttggcctggatcccctccctttgtttcatttcacagattacatgttgacagcaggaaaatcaacagaaagaccatgaggctagactccaaaagacttagtaatgctgctgggtgggccatgaatttttaaaaacacatgaagggccttctcagaagtgaagttttaggaaatataaaatgcatagctgggatacattatagtgtactgatagaacaaatattggatatagcagcatctaataacttctggaggaaaaaatatttttcacattactccaattatggccttatatgacaaaaaaagaaaaaaaaatccctaagagaaccactaacatccactggttttgtagaaacaggatacccttagtgcacttaaagttggaaaaatggctctgcctttagggccatgcaatgaaacagactgtgtggtagttgacacaggaagagcagagcagagtttataacaatggccacaagacagttaagaaaatgctttggggcttttaagcagcagataaggtgactcagaggaatgttagacaatcgcagaaaagcaacttcagcaaagtttttgattcagtgggcactgcatacttagtccatgctctgcatctgttctttcacagtctgtcccttcatcgacttgggcctacaatgacttttctgggaggggagagggatcaacacaacagcatgcacacacctgaaataaagaatgaatttctgattttcagattttagtctctgacataaccaaagaagtgactaccatagatgttaactttttttttttattattatactttaagtattagggtacatgtgcacaacgtgcaggtttgttacatatgtatacctgtgccatgttggtgtgctgcacccattaactcatcatttaacattaggtatatttcctaatgctatccctcccccacccccccagatgttaactattaataacataaatgatgctcacaaatatgcagatcttataataacgaggtaaaatagcttaaaaaatagatggtagaactgtagtccagggacactaatagaagtgacccataacattacatcatctccacttccaacaaaaatcaggcaaaagaaggaaggagactggcaacccaatgcacagaactatatataacaggcatactagttattggttggttataaaccagtgggaataaatcttttttatatactgactcttggtttatgtcactgaggcacagcatggaacaatagaaaaccggactgtaagataaatacatttgagtaactggacttttgtaaaccattagacagacatttgagaaaccaaatttaaagctgtttgtgagccatgttagcctatcaaggttgaaattcaggagagatacataacgaaaaataaatgcttttttttttgtgacactgtgatctgatgcattgggaatgtgatcttgtgaatcactcaggtgagcaagcctgacatgagtgggcataaaggtcagtaactgaagaggtaccaaaatgtgctacatgtgtcaattgtgacctaaagaactgaaggcattcaccctcccttgaagtaatgaagctgacacagcagggggctgcaaattccactgcagatcagggtcttgaagctgacatactgaagagtggactcccacttgagatacagagtaggaactactgtttcctacggctactgaatatcccacaaactaacctcctcagcatgccattattaattattttaaagctcttaaaggtctcattttataatagatcacatcagaaggaagactaataaggatcaggtacaaactcatacttgctggacatatcattgcatatcatccccaagtttttggcactacataatgttggaatagattcttgaatattaaattttaaactaagggagaacattggcttctaaattttacaactatagtattgcagctaaacacaagtgcagatgggcagccttataactgcatgagtaatcttaaggaaaacttattggtgaacatacagaacatttcacatgcatttgtctacaaaggacaaactcttcccaacctcagaacttgatatgcgttaggacattcctctcccttgggctggtgataaagctccaattgaaatgagaaagattcttcatgcctggtaaatacgcaagtttccaaagatattgccactggccaatcaaacctgaatccaaaaagcatttgtttctagcaggatataagatcaatatgcaaaaataaattgtgtttatgcaattgcacagcagaatttaaatgtaaaaggaataccatttacaataatgtcaagtgtataaaatccataaatgtgaatatgactgaaaattagagcatatttcacagagaacatagtgcaggcctaataactggaaagatattgtttgctcatgtgtaagaatattgttgagatgttcatttcccctaatttgatctatgaattcaatgcaatccgactcaaaatttcagcatgcatcgttggtagaaaatggcagctgattctaaaattaacatgaactagcataaccaaaatgcctgtataacgaagtgcaaaattggagggctagctccacctgatttaaagaacaatcacagagttgtaatggccacaacagagctttggtatgtgatcaattaaatggatcaaaagaaaatagagtccaaatataaatgaacacatatattgagaacagatttttgacaatcttgaaaaagcaatgtatttaaaaatgcataatatttcaacaaacgattgaagattttctttttaagcaatggatgtgacatatttgtaaccatataaaaataaacaagtagaaaaaactgaattcatgtgtcatatcatatattaaaattagtggttacaagaggctgggaaggagataggggagaaggaagaaaagatattggttaatgcatataaaatatagttaaatagaaggaataagttctagtatttgatagtatattagggagactataactcaaaataacttcttgtatattttaaaataactagaagagaggaattgggatattcctaacataaagaaaagataaagttttgaggtgacagatatactacttacactgattcgatcattataaattgtatatgtttatcaaaatatcatgtgtatccccaaaatgtgtgcaacaattatacatcaattaaaataatgaagagtacatcttagacaaattaacaatgattccaatcccatcgagtaccttttctgaccacaatggtatgaaactaaaaattaactacataaggaaaactggaaaattaaaaaatacatggaaattaaacaacttgcctttgaacaactgattgatcaaagaacaaatcaaaagggaaatttgaaaatatattgaggccaacaaaagtgaaaacaaacataacaaaatctttggaaacagcaaaaacagctcttaagagtcaagtttataaccataaatgcatacattaaaaaagaagaaagacttcaaataaacattacacctcaagaaaccaggaaaaaaacaacaaaataaatccaaagttcactgaaaaaaggaaacaaaaatcaatgcagaagtaaatcaactgaagaacagaaatactacagaaaaataataaaagtgagttgttggttttttgttttgttttgttttgttttgttttccttttcctttctctttctttttctctttttaggagagacaacgtcttactattctttccaggctgattgggaactactggcctccagtggtgatgcaacgtaggcctctcgcacccgagttgtttttctggaaaaagtaaaattaacaaacacttggctaaactaactaagaaaaaaatagagaagactcaaataaataacatgcgaaatgaaagtggaggcattacaacagaagcctcacaagtaaaaaggatcataagaaactattattaggccgggcgcggtggctcctacgcctgcaatcccagcactttgggaggccaaggcgggcggatcacgagttcacgagatcgagaccatcctggctaacacggtgaaaccccgtctctactaaaaatataaaaaaattagccgggcgtggtggcgggtgcctgctacccagctagctacccagtagcgtgtagtcccagctactcgggaggctgaggcaggagaatgacaggaacccgggaggcggagcttgcagtgagccaagatcctgccactgcactccagcctgggcgacagagcgagactccgtctcaaaaaaaaaaaaaaaagaaaaaagaaactgttattaacagctctataccaacaaattggataacctagagtaaatggataaattcttagaaacacacaacctaccaggattgaatcaagaagaaaccgaaagcctgaacgaccaataacaaataaaaggactgaagaacctcccaacaaagagaagctcaggaccaaatggccacacagctcaactcttccaaacattcaaaaaagaaccgggcgcggtggctcacgcttgtaatcccagcacttcgggagtccaaggtgggcagattacctgaggtcaggagttggagaccaccctgatcaacatagtaaaaccctgtttctactaaaaaaatacaaaaattaaccgggggtggcggtgcgtccgtgtaatcccagctacttgggaggctgaggcaggagaatcgccttgcagtgagccgagatggcgccactgcactccagcctgggagacggagcgagagtctgtctcgggggaaaaaaaaaaaaagaaagaaaaaaaagaaaacgaaaaccactgcaaatcataatgcattttgtccactttctgagaatgtgatttcctcttcctgtggaaacagcaataatttttatgagggggtgctgcccggaccccactggaggagtgggtaagatgaggattgtgctcggtgttgcctccctacagaaccacacatactgatctgtaatacctgtggcccctaagtgtccgtgaagggactggtccctttacaacattgcgtatggctgcggaaacccactatgtggcaacaagatgtatatgtgtgggttggtggtaaaaccattataggcaacggaaattcaaaatgtttcagaactcttaaaagttcgcctcatgtagtatttggtttcttgcagggggccccaagcccccggggctgtggtcagctacctgtcctgggcctgttaggcaccaggccgcacagcaggatatgagtggcccgcaagcgagcattccagcctgagccccgcctcctgtcagatcagcggtggcattagattctcatagaagcacaaaccctattgtgaactgcgcatgaacgggatctaggttgcgcgctccttacgagaatctaattaatgcctgatgatctgaggtggaacagtttcattccgaaatgatccttccctcttttcacgtcccccacccctggtccaaggaaaaattgtcttccacgaaaccagtccccgaggcaaaaaagtttggagactgctggtctacagtgtcccaaaacccttttctatggttccttcccaaagcctggaggctctaagtcctcccctgttcttatactcctgtgtgttgagaaaaatagcatttcctatgctctgaaggttctccagaacattctttctaggctgcaggatggagattaataataacagaatatttggcatggccttgttagccaatccaaagccctctgggctgaagtgggggtttttcacttcagggtcatccagcctgggtaccttccatctcagcatccccaggcacagacaggaaggtgacatcaccccatttacatgatgtctgtctttgtggcctgggccactgggtggcttacctcagaggcggagatgtcagagatgggtgttctgggcatgattaacaaagggaaaactgagagcgttcctactgaagccccttctcctttcagctcccacccaggtggcctgtcctcacgggccttggagtggagacttgagccaccaactgtcagaggtggagacttcacaggcacagctggagccaagaaccctggtgcccaattgtctgtgactgcaactggatcaagggtttgactgtggctatggcttagccaggcaggatgtttcctccaccacctgcagcttcacaaccaacggtgatcctgggaaccaatggcccttccaaggtagggaaggaaaggggaccaggaagctctcatccgggtgtcctggtcatggtgctgtgaggggaggaggcaatggggtctcttcgtgctccctcagagtcaagcagaaatccacaatgttccaacccagtgaggtgagcaagagcctggggtttaggatcaaatctgctctcaggtcctgggcttaacccttactcattattcatctcggccaagttatttgtggtgttggcatttacatctcagtcctgtcatctgagagacctgaaaaataatatctacattccatcattgttgataacattaattatgataatttccaaagggctaattcagtaaaaattgcttaataaatctatgaatagatgttatctaattctgttatctttctggtaagttagcactcaggaaatgacttcacgtgcattgtttcaactgaggaagagtaactgttaggatctctactttctagagactcccttcctgtgtttacttagaaagtatcttttgccagttttctttctcttcctcagcatccctttttaagtcaatttcccccggtcatgcacttcagtaacaacctattaggcacattagtaaaagtgcaaatcctgggcccacaagtcagtctcctgacatacccagcttcttgctctgttttctcccctcgttttgaaataaaagaatgaaagggcaaccttctcatggaaagggtataaatctgtctcttttatgaaactccatttagttcatcatctccattcatgcccacggccatgtcctcagttttcttctcacagggatccacttctgcccagatttccttaaaaccctgggttgtgttcatccttactctccgtcccactcaatatctactcctggagcccctggggctgcctggtgctcatctgtcaatcgatgcccccagccgaggaataaggagacccacgtcctcaggaggagggagggtcacgtgagataacgagcaccatctgggtccatggagaggacacatggaaaacgctcagtgagtgtcgggggatgcgtagtccctgacacgtgccctgataactttgagtatttaaactgatttcttcccactggtgtctcttttgcttctccatggattcctgcacccctagtcaggactcaccccgctggctccaacactcttacctgctggctttcccaggagtccggatcactaaccaggttccaggcaagaggacagagtgaatgccttttgtttcattgtcctttacctggtgacttctccttgctgtctaatagggcatttgtttctcaccatgtcttctctctctcgttcatcttatttttctaaaattttttccagtttcagtggaccagattataatgttagtgattataacgctaattcaacatcttccacatccttatgtaacaatttcttccaatagatttatatatataaatatatgcatttatgtcattggatatatatattatgcatatttggcatgtatttttaataaaatgtagatatatgctacatacatatctgcatgctcatttcatcaatatctcatgtttagtctatccaattcttttctctcatatgttcatttaatgttgagttttagaatctcctccctcccaaaacacagcctgtatccagtctgacttccttgcctttgccttatctacctggaaactatttgtgtttattaatcctaaattttttgaatatgtttgtcagttgggatcaccttttcctcctggcaatcttgtcattactgggtgatgcatgaaaaatcaacaatacagaaaataccaaaatgtctttcctggcttccctttacccgttggactttctcattcaagaccactttccttctctgatgatcctcttgggtggaagagaaagtcacagtaagatcatggatgacagtgaacactgttgggtgtggtttcattttcagagctgggtttagagccttcccttgaatgaagaaccctccccagctggaaggtgatgctattgaaggctcagctgacaacatacatgggcatcaagtcattggccacattcatgcctcaagtgtcctaaaaccgaagatgatcaaaagaaaactgctgttcagcaagtggagactggcatgcagattccctggcctgcaagcttagagcaggaagataatcacatctatggctcttagctgcactcactccttattcctctctgtctatgatgacagctccttctcccactgcttttttcttctgtatttgttctctccagcagctgctgtcacctctgtctggtattacctctgtgtcccatgggctgccatgctgccaggtccttctgatccccatcccctgaactctgctctctgaactctgctctgttcccactgctgttgtcctaagagtccctctcatggccgcaggagagcccaacttccttgtccccctccaagtgcatggtgtgagctgctaaacacagggttctttgcctggaattgcacggcttgagtaatttgcctttcctttctgcatcccaaactccattgcccctttctgccaggagcattgctttaatacgtcatttacacacagatttttctcttgggacagcttttgagcaacacaactaagtcaaactgtaaccctcaccttgtacatgggaatgagaagtgttaaaactgagcactaagaactccaaatcaaaaactaaattagaacctgggtcacagacgagagttccctactagcctggagtcaggtgtgtcttcatctctagatgggcaaccttatgccagcgtggatgaagtttccagggactgtgtctgctcttcatggagtcacttagctgacattaactggagaacatttatgacattccaaagggacctcagccaaagatagatgcagagggcagggcaggactttgaacctgcgtagaccacaaagtgcattctcacctctgtcctttttattcacgtatttacttctacaagctcagttagagtctaaaacacaactcaggtgaatcttgaggacagagaaataagagagcatttaatgaattaactttgagaaaagtgagttcaggggccagctttatgtctacacaagatgatagacaagaacctatctacaggacagactttgcctcagaccagcccaagtgagagatttaattgaaatagtcagaagaaagactaaaatccacagagccacagagaatgaaggcaatcacgagagaaatgaggggataggaaagaaaatgatgagaaatcaggttggttcattcattgtctctaaatcctgctaccatgtaataagcacctggtgagatttcaataaagatgaatgccttgaactgacatcttgagattctcacttaaatggtctggggtgtgatgtgagcatcagtacctttaaaaaacttccatgatattctaatatacaactgaagatgacaaggaccactggtctactctgacctcaggttttcaacatggagatgaccacttgtgtggctactccacacaaaaggcggaatatccatcagacattgatgggatctgtattcacctctcaacagtagtatttgtagaacgtagaaaaaaattaaaaagaaaaacaagaaaatagatggattagacctgtagtctctctacttaaagcacacttgcttaattttgagtacaagtaaaataagaaatagtcattgtattgaaacccagtatacagaaaacaatacctcgtatattactcatattcagatttagtattttcttttaaattttattttattttattttattttatttttaagacagagtctctctctgtcacccaggctggaatgcagtggcgcagtctcggctcactgcaacttctgtcttgcggcttcaacaattctcatgcctcagccttctgggtagctgggattacaggtgcctgccaccacacttggctaagttttgtattttctagtagaggcatggtttcaccatgttggcaaggctggtctcgaacttctggcctcaagtgatccatccacctctgcctcccaaagagctggtatttaggcatgagccatcatgcccagccttcttttcaattttaaaataaatcctgcagtttacatttccacacactgattccacagcccatgaatgggttcggcactgcaatgtaaaaattctgctttgctcaattcttgtcattcagccaagtcctcagagagaactcgtaggtctcactccactagacagaatataataataagtaaaaactgaaacttggccgggcatggtggctcatgcttctaattccaacactttgggaggctgaggagggtggatcacctgaggtcaggagttcgagaccagcctgaccaacatggcaaaaccctgtctctactaaaaatacaaaaattagccacgcatgatggcacatgcctataatcccagctactcgggaggctgaggcaggagaatcacttgaacccggaagacggaggttgcagtgagctgagatcacaccactacactccagcctgggtgacagagtgagactccatctcaaaaaaaaaataaataaataagaaataataataataaaaaaactgaaactcaggaagagatgatatatgaatacttttttatgctacccttgatgctggcaagaaattctaaaaagaaatctttcccaacaaaccactctgggaaaaatgtaacagggagaggagaatgtaataaaacacaaactaatccttttcactttctacttcagagttttgttgatcagatattgagcatgtttctagaaatgccttaaggtgtaaccaggtgtggaatcaacttcagggaattagggataataagttgggccatggttacaatcaccacccttcctttgtaattccatttgactctttccttttcttctgatcctttttggaagaacacataatatttcttttgtctttttctcattttttattttaaccaacaaaacaagcagcagtgacatcatatttctttgtaaaagctcattcctatcctagccaaggtgacccagcaacctctagtgactgtcgagaactccagattggagaattgactctcccttctctctaacttattgaaagagacttcgtgcgtgggttctagtttcagggttgtccattgcaagtcatgtggctttagttaagtcagccctgtggcatcactgctcctctgttgtaaaaggcagaactggatgtggatgcggtctgaggtccttcctgtatctcacctccagggttcttcccatggccctgcgcacccttccctaagagacggggacatggagttgtaagggagtgggtttctctgcaaaaggtcctttccttctgcagccctctgtttctgagctttcatggttgatgctgagaacatcctcactgaggggtgtgaaaagccattactctgctccagacactggggatcaggaggaaaggggctgctggttgggcagagctagggtccctatatccttcacctcaagctgactggaagttcaggggtgtttatttttcacttgcggatggcacttgcctcttcactcagcctgaggctcacccttcagctcatcctcctagcaggagctcagtttgcccctgggctatcaccacttaacagtccctctagactcagccatcagcaggacctgacaaagatgcccatttgatctttccttctctctctcctacagatactaaatgctgctggaacaatgaaaagaaagaacggatgtcacaaaagcattttcatttgatgaatagaactaaaagagcaaagcaattgaaagctcaacacaacacaggagggatccatggctgaggattgtatttcagaaccactgactgctcttgacaattgttaacccactaggctcctttggttagagaagccacagtccttcagcctccacttgataccaatacttaggaagaccaaagccagatggacaaacagcattgagaggctttagccctactcctctcagcttccatcctgtagagaacaggagtcaggagctgctggcaggagacagcatgtcacttgggactctgccagtgcagaatatgaacaatgccatgttcttgctaaaaatgcttagcttgagtttcataggaggtaatcaccagatagacaactgcagaatgcagaatactgagcaggacaataacctgtctccttcagacagtccatgtcaccacgaatcacacaataaaaaggagaaaagacattttgggttcaaaaaaactaaaaagataatgtagctatatttctttagttattttgaacccaaagtatctcctcatctttttgttgttgtcattgatggtagggacatggacttgtttgtagaggacaggtcagctgtctggctcaatgtcctacaagagacaggggggacatggaagcgtacagctatatttgtggattagtctagctatctgttcagtatttaaagttgttgttgcatagatatttatgacttttgtcaggggagggtttggtggattggtcctttcatcattttataacgtccctttctctctctgattagtttctttgttctgaaatatactatatctggcattaatatagccagtcttcctttcctttagctaatgtttgcatgatatatctttttccatccttttgatttcaacttgcctgtatcatcatatttgaaggtagtctctttgtagccaggatgtagttgggtcatgtccattaacctactctgccaatctctgtcttgtaattggtgtacttagcccattgatatttaatgtgatgattgatatggtagggcttaagtctgccattttatttttccttttctgtttgttctctctggtttcattttctggatatgctttatttttcttacctgctgtggtgacttgaacatctttgagaatggtgttttgccttatccatagtattttttagtatatgcgtttgtatagccctcttggtttttccaggtatatatatatatatatttatatgtctgtgcatctatatctgaccacatggtatactggtgtcattgtttcaccagttgagtgaacgatagacgagcaaccttctatataggtctctttacccttccagtttataattgtttccaacattttctgtatgtagagttagaaccacatcgaatggttctatgattttttttctgaaaccgtcaagcatagtttagaaaacacaagaggagaaagaaggcctattttgctcactgttttttaaaattttctttctgacatcccaagtttccttctttaatcatttcctttctgtctggagaactccctttagcctttcttttaaggcagaactgctggtcaaagattcccttagcttttcttaatctggaactgttttgatcttccccttaattcctgaaagatgtttctgttggacagaggagtctgggctgacaattattttctttcatggcttgaaaagcactgcacaacttctttctgcctccatggtttctgatgagaaatccatcatcaccggaattgtttttcctttctaggtaaggtgtcacctttctctgttgttttccggatattttccttgtctttcttttccaacattttattttgtcacgtgtcttgccatagacctctttgggttttatcctatttagggttctcacagcttattgagcctgtaggtttatgtcttttgccaactctgggaagctttcggccatttacttctttgagtatgttttcagccttgtcttcttcctcttccccttccagacactgataacaacatgaaagtgagaacttttgaggtagtttcacaggtccctgaggttctgttcactttcccccccagtctattttctccctgttaggattctgtaatttctgtttttctcatctgcagtatatgaatttgtttgctccacaccatccattctgctgctgagcctatctgctggactttttattttagttgcatttttcacttctaatacttccatttggttcttatttatgtcttgtatttatttgctgagtctttctacttgtccatttgtttcaagtgttcttataagtactcattaaatcatttcattaggcttgcctgctttaaactctttgtcagacaatcccaacacctctctcatctcattgccagcgtgtatttgctgtctattttcattcagtatgagattttcctagttcttggtatgatgaatgattttcaattgaaacttggacttttgggtgttatgttatcagagtttcgattttattgaaaccttctgttttaactacctttttttgagtctgtttctgcaggggaagaagagtggtgccatctcattgtagccaggtgtgtgtaaaaatccaggtttctcatctgactgacctctgttgacaccctgagtggaggagctgctaaggtaggagagggagttccagcagcccactcctcctccactgctacatccctggctgggtgggtaggagtgcttcattactgctttccacgtggcctccagtgacaccacaggacaagggcagccttattactgctgggtggatgaaagtcctgactctccaccaggactcctctgataccagcctagcagacagagggagaggtgcctcatgaccatctaatgaagtctaggctccaaatgtagtttctattgacagggaggtaaacatattatcacctggcagggatgatgatgacagccccagcttcctcctctaacatctgtcattgaaattgtttttcccctctaggtaagatgtcgtctttctctgttgcttttgaggtattttctctgtctttagtttccagcattttagtcattgtgtgtctcatgataaataaaatgctggaacctaaagaacccccggggcaaggtgggggtttagcatatgtcattatacctgcgcaagtgtgaaacccgaagcccctcactgggattttgctagcttttatgttgatgcagccacagcttttcttccacggtgcttgacctgaggaaactgatgatcgtatatgtgtcttgtcttgctagactgcccctttgctgatcctttgcctagagagagcaagattgtattggggtttgctggatctgtagccattggtatttctgggttgccatctcctttggctctacatctaggatgtatgcgggggcatggaggaatcctgggaactcatctcctggctttctgtgggtcttgaggaagccagatggcctcctaccttctctttgcccttcagtcttcctatgtttgttgtatgtacaatgcccaaggtttttagatgtaatgagcaggaagaatagggcaaagttcatctattccaccttcccagtgtatgcctgtgatttccctgtcttgccttattgatttgggtaggattgtcatgtgaaatatcagtggtgagcgtggtcttccttgcttagttcccagtcctagagggaaagcatgtggtctttcaccatgaggtaagaagttaactgtgaatttttttgtaagttgtctttatcgagctgacaaagtcctgtgttcctatgtttctgatagttgtaaaacattctctttcttcccttctttctattttttcttatttctgttgtttgttttgtttttttgagatggagcctcgctttgtcacccaggttggagtgcagtggcgtgatttcggttcactgcaaattccacctcccaggtccaagcaattctctgcttcagcctcctcgtagctgggattaacaggcacctgccaccatgcccagctaatttttgtatttttagtagagatggggttttgccatgttgactaggctggtctcgaactgttgacctcaggtgatccacccaccttggcctcccaaagttctgggattacaggcatgagccaaagagcctggcctcccttctttatttctatcatgaatagatgttgaatttgtcaaatgatttttcttcattgactgataaacatttttgtggtctggttttggagttggggtaatcatagctttacagaaatagtcgagaggtgttccttcatcttctattttctggaacagattgtacagaattgatgttaattcggctgggcgcggtggctcacgcctgtaatcccaacactttgggaggccaaggcgggcggatcacgaagtcaggggatcgagaccatcctgactaacacggtgaaaacccgtctctaccaaaaatacaaaaaatcagccaggcgtggtggtgggcacctgtagtcccagttactcgggaggctgaggcaggggaatggcatgaacccggagggcggagcttgcagtgagccaaggttgcaccactgcactccagcctgggagacagagcaagactctgcctcaaaaaaaaaaaaaaaaaagaattgatgttaatttttcttcaaccgtttggtagaattctccagtgaaaccatctggacctggagcttttctttctggaaattttaaaattaggaatccaattattttcatagttacagagctactcagatgacctgttttgctttaggtaagttgtggtagttgatacttatgacaaatttgtccaattcatctgggttgtcaaatatatgtgtgtacagaattttaaatagtttttcccttattattatccctttgatatctgcagtctgtaatgagtgtagtccctctttcatcctgatgttcataagctgacttctttttttctttgtcaagtttattgatcttttcaaagagacagctttattttcactagtttccccttttgtttttttctgttttcaatgccattgatttccgctattatctgtattatttccttccatttgctttaggttttttttttttgtagattcagtctcattcccatggcgcaggccggagtgcagtggtgcgatctcagctcactgcaacctccacctcccgggttcaagcgattctccttcctcagcctccagaatagctgggattacaggcgggtgctaccatgcccagctgatttttttgtatttttagtagagacggggttttgccttgttggccaggctcgtttcaaactcctcacctcaggtgatccacccaccttggcctcccaaagtgctcgtattaccggcgtgagccaccgtgcctggcctgctttaggtttcttttacttgcttttttcttgtttcttgaggggggagcttaagtgtattcatttgagacatcccctcttttcttttatcccttttaaaaacttttgtatataattattattgtaggaagttaggcttgggcccgcaaactatggaagaacagaatatactaggccgctgctttaatagctggtgcctgcttgtcgcccacccccactcccccaccttagctgccttgtccaaaccaaagagtttagtctagaatggacatttactagcctgcaaaatagttcactacatctattcttatcagcttgcctgactgcccaggtcataagtcaaatacttgaaaagcccccgagctgaccatgattgcaatgcattatggactgcaacaaaatacagggagacaaccctaaaaaaaaaaaaaaaacaacctaaaagtccaaacccaagatccaataggcgacatccgggaatactgtgaccccatagtactcagcctatgaggaaccgggggaggcacttccacactaggggataaattgcttgttgtaagcctactgggtgtgcctgcctaccagacacccgatcttgcaagactgtcattaataataagtcgcacttctgctgttttccgggtcttggagtccattctttgggtttggacaggtgagtttatttctcacgattatttccaggcaggccttgcccagtgggtggctcatgcttgtaatcccagcactttgagagggtaagcctggtggatcacctgaggtcacgagttcgagaccagcctggctaacatggtgaagccccgtctctactaaaaatacaaaaattagccgagcgtggtggcgagggcctgtggtcccagctactcaggaggctgagacaggagaatcacttgaacccaagaggcggaggttgcagtgagccgagattgcatcactgcatgcgacagtgcaagactccgtttcaaataataataataataataacaataataataatggcacgacctaaagttatgcaagcatttgccttagataaaatttcaagttttcaaagttgttagctgggtgggcggcatggctttacttcctatttcttggtatgtcctaatcttgttgaaaaagtttttctttttctcaaaggcttatttcagtggaagcccatctgcaaaatctgttattaatttaaattagaaaatcactacaagtcccactgacatgtgggttattgtttttgcgagtgacctaaggccacctctcgggggagctgggggttgccttcccacgtctgcgcgtctgcaccccatgcccgggcctggaagtcagactcgggggcggtgctgcagcaccaggcctgcagtcctaagcgcggggtcgctccgggcccccgagggggtgtgtcttctgcccctttaacctggcaggggcggttcaagtggccctggaaatcagcgatttgtagggtcaagggctggtgctttaaaagagaggcggaggggagagagggatttcccggtctctgctgcactctgtctatccgctcggttactccttttcctggcccgcgcgaacccgctgtgccgcagaggcggccatgtacctttaaggccccgctgcgcctgcgccttgggctctcctgacgcgccgggcgggaccctgaggagccagctggcgcaggctatgggctgggcggcggttgagacagcggcggtatcgggaggggtaggtgagggtcgcgaggctgcgtgagcatctgagtgaacgcggtgcttttgggaacgcgggacgggcgacctgtggcgccaggagcgggccgaggcgtggcgcacggatgccgtctggatgggaagttacggtttacagcgaagtccacccagcgtttccgaggtgaaggcgccgcgccaggccgggcgggcggtgagtccgggacccgcgggtacacagctgggtcgagctgcggctgtcgcaagttttgttgcgagcgacggagggcgaggcggggtggggggttgggagggcgtgtgttccggccccgccggggcttaagttccatgcgttggattcctcgcttgccgctgccgcccgcagccctccttgggcgctggggaagaaactcgctggcgggtgttctgtggcatctcagggggtggagggacgagcagcttcgggggcacgtcctcgtgtatcctgtggaggaccctgaccccgcaccccaccctcgaggccagaaatcggttgcctctggggacctgagaagcgagaccactcgcgcccctgacttgcaaagttggggtctttattggcctccgggattctgctcctggcggtttctccaggctggtgatgggcaagccgggtgtaccaagtccaggatgcacatgaggagcgtttgtagcagtcactgaatcacctcatgactagcggggcaggcctctaattcaccgcaggatttccggtaggttggattgtggggttggtgtttgcactccaaagagttgctgtgatttccctgtatctgtctttctggcttgttagatcttctcatttggcgtcctttctccgaagagttaaccaagacgtttggcatggtttccttgctttcctcctatcttttgctgctagagctgctttcgaaaagaagtcttttcttgcagtggtatcttttctttgggttacagtgttgttcatcctttctttgccgaaagaatgaatcccagtgcttcacaaggttaaaggaaagatctgctggtagtgtttagtctttgttctgagctgatatgtgttagtagctttttgtttttaaattttattagtaaaatttcaccagtgaaccagaagctctttttttctgttgtgaaatgctagctttaagatttctgagaactttgtgtcaaagaaatctttgaaaagttactgaagtatacagagaggttcacaattttaaatgtgcaggtggtccgggcgcggtagatcacacctgtaatcccagcactttgggacgccaaggtgggcggatcacttgagcccaggatttccagaccagcctgggcaacgtgccaaaaccctatctctactaaaattacaaaagttagctgtgtgtggtggtgtgtgcctgtagtcccagctacctggtaggctgaggtgggaggatcaccagagcccaggaggttgagattgcagtgagccgtgatcatggcagtgcactcccgcctgggtggcagagtgagaccctgtctccaaaaaaaaaaaaaaaaaaaaaaaaaaaaaaaagtacaggtaatgaatttttaccaagtgaaccaccacagatcaagaaatagaacattactagactggggtatatttgtaggagtggcattgttggttttagaggtatatgaatgataaaacttagtattacatattgttgaacgttttcccaaagtggttgtaccatttagcagggatactctggttaccccacatccttgctgatgcctgtcagttaaaaattattttgccattctagtaggggtgcagtaatgtatcagtgtgatttcattttgcattttcctggtattgagattgagtatcttttattgtcatttgtgtgtcctcttttgtgaagtgcctgttaaatctttttatccagttttcattgatatgcttgtttttctgttgatttgtaatacttttttctggttatgtgtcctttctacgatatatatgtattgcatttcccttttttcaatctgtagcttgccttttcgctcttttaatggtgcttattcatgaatggagattctctaactttttttttctttttgagacaagatctcactctgttgcccaggctggagtgcagtggcacaatcacagctgaccgcaaccttgacctcccaaggctcaggtgatcctcctgcctcagcccccaagtagctgggacctacaggtgagcaccaccacactcagctcttttctgtatttttagtagagatggggttttgccacattgcataggctggtctggaattcctggtctcaggtgagacatctgcctcggcctcccaaagtgttgggattacaggcatgagccactgcacccagcctgagattcttaattttaatgaaattatactttatcaatcttttcctttatggttagtgctttttgtgtcctgtttaagaaatcaatgccgaacctaggagtatgaacacatttttctgtgttaaccttatagcaattttattttagtttttgcatttctttttttttttcagacagggcctcactctattgcccaggctagagtgccgtggcaggatctcagctcactgcaacctccacctcctggctcaagcgatcctcccacctcagcctcctgagtagctgcgactataggagtgtgccaccatgcctggcttaattttcatattttttgtagagattgggattcaacatgtttcccaggttggtctcaaactcttgggctcaagtaatcttcccacttcaacctcccagagtgtggggattacaggcatgagccaccccacccggctatgattcactttttactacatggatgtgtctgcttgatccagcaccatttattgaaaagactatccttttccttctgcactgtttggcactttttttcttaaatcggatgactgcatggtcatccaatttatgaaattagtgtgggtctgtttctgtttctggaccaacctgggcaatatagtgagatcccatctctacaaaaaataaaaataataaataaatgagtaaaatttaaaaaataagtgcatagagcagatggagtcataggtgataatttataaatgattgtcagtttcttggctacatacgggtgttggtaattcagatgtgttgggcattcagggaaaatgtattaagggaagtatgtggtgttcacagtgattgctagatgttcattgtgacttgaattagatgttatttgagcctcacagagctacagtcttgactctttatttatttatcttttttacaatttttacaatcttcctgtcaaggcagtaactcttttatacttcattgttcttaggtatacttaattaccaggaaaactttatggatcgtacctaaataagcgttaagccatttaaagggccgacgtgatgtgatgtaaacaatagtattctacataatagttttaggactacatcgaacaattttttttttttttcttgagacagtgtctcgctctgttgcccaggctggagtggagtggtatgatcatgggtctctgcagccttgacctctcaggctcaagcagtctgcccacctcagcttccttagtagctgggtctacaggcatgcaccactatgcccggctaattttctattttttgtagacagggttttcctgtagtgctcagactggtttcaaactcctgggctcaaatgatcctcccaccttggcatctcaaagtgttgggattacaggcataagccatcaccgctggccattttagttttaataatttttatgtttttctaatttaaaagatttactaaaatctcttacagctattatttatgagtatagtattcattgttgttattatgattattttgtatgtgttcaatctcattttcaacataagctcctggaaatttgagattttgtctcttattcaccactgtattctcagtacttgaccttgcctggcatgaaacagatattgaataaatatttgttaaaggaatgaatgaaggaacatactaataccatattcaacaatctccaagtgtcacagttttcaccatctaacaaataaaatagcttgtatacagcagagtcacagtcaacctgacataaaaggaaatgtcaatgaaaaataaacctttgtatgtgttgctgctaagattttggggcttttgttactgtagcataacctagcgaaagctcagcgagacagcctgtagaatatacgtgtacagatagaccagatagaccagtagatgagattccaaagaagcattaactacacccacacactcataattccctaacagaaagaatcgaattcttgttcactaagatctgcctcaagtattactttgtgaaaacttccctggctactcaagtatttagtcaggactctttatttttttttcccccaggctggagttcagtggtgccatcatagctcactaacctctaattcaaggctcaaggaatcctcctgcctcagccttctgagtagctgagactacaagtgtgtgccaccatgctgggccaatttttcattttttattttcagagatggggtcttactatgttgccgaggctggtgaggactgttgattacatatgacaggaacccaaacaattctagttccccaccacctttcaacctgctcctccctgggtcttcccagtctccgtaaacggcagctccatccttcaagttgccgaagccccaaatctcaatattaaccatgatttctctcttttatctcataggcaatctgaaagcaaatcctgtttagatgcaggcgaaggttcctggtgacccaggctctcaccttaccgtcccttaccgtcctcctgagggtgtcctggagcttcagtgctgtgtgttcttggcctccacgctggggctgccaccaactcccactgtccagggcttccagtggactctccgaggtactgatgtagaaacttccccattcggtgcaccaagagcaacctcacacggtgtgggctgaatgaagagctgccagatcccacaggtaaaaaccctgaggcattgccagctcgatggagtcagagagtcctttttctattatgactcagatgtgaagggaagatgccaagggccctaaacatcgcagggccttgcctggcatgaaacagatactgaattaatatttgttaggtgaatgaacaaatattcacagcgtgtgccaccctcgacctgcagtgccgtcgtcaggtggaagtgattttacctcaggagaggagagtgttctctccaggacttttccttagtagctagatctgcatcccactccttgctcttcccctcttaccccccattctctgcccccatttccgtctcttgtttccaccctgccgtcccctttcacctgctttctcctcttcagctttcatggctcaccccctccctgtccacccgcatcccccaggctaaggccctgcactgtcctgggtggggagatgtgtgtggttttaggcagtgccctctagatgtgtccaggatggggaaacatggctcagttgccagtataatgtgttaaaagagaggccacttttgaaggccgttcccatctcccattccagaatcctgtaggacttagaatttatgggccacagtggaattcttggttccccaggaccttgtggtggatgccttctttcactgagcattcatggggtgactattaggtaccatgccctgctctgggctagagaccccataacgagtaaatctcaggtcactaccccatggaacccaccactgcaggcattgagagggggagaaagaaaggggcatggcctgtttgtatccttctcacgtggccgtccaccaggtcctgggggagtgggagccagtgcaaggagggaagtccagtgagaatgacaaatggacgatgtcagacccaggggctgaggcccccacctgcagctgggaagcttctggagtggacaaggagcagcagggaaggttgcggcctggtgttctgggatccactgtctcatctcattcttttgggcaccagaacttatccaaagacaagactcagtgtctctggcaacagtgggccagaggaataatgtgtttcagaggaggaagaaggggttgtaccccgtggaaacagcatatagttttacagtagtgcatctgtctccaataactagttagcgtgttcctgttaatgggaaatactggtggtgtaagttcccctggatgttctcatcttcatgtaaatttgttcatttccttccttccttccttccttccctacttctctcccttccctacttctctcccactctttttctctctctctttattctttccctccctccttcccttctgccttccctcccttcctttcttcctcccttcctctctccctccctgccttcctccctccctccttttcttcctccctcccttcctccctcccttccttccttccttccttccttcctccttccttccctccctccattctttcctttcttcctttcttcttttctttttctttgtctctcatgctctctctttttctttcctttttgttctactttttaaaaaagaccacactgcactgaaatctacattacttaccaaaacctctggagctgcttctgtcttgtaggcagggagctcgtcctgtagcccttaggtcctcccagcctcctcctcctctgatttgtgggtgccactggggcagctgctgagtctcagtggttcctagtcatcaccaagttctgcccacctagatggtttgcacctgtccttaccagaaccctgcactgtctagatgactgaggctgcttctgcctaactgatctgctagctgtgttccgggggcaccccagggttagaggtaaatggcacaggcattgaaatctccaactgctctgactccaggttggtgcacttcaatgccaagtactaaccacacaataacaggatgccaccaaaaccttggtatggggctgctgcatcctaattaaaaaaaagtaatagatgttattttttagaacagttctaggtttacagaaaaatggagtggatagtacagagagttctcctaggctcccctgtcctccagcacacagtttcccctattagtatgttgtattagtgtggtccattcgttacaattgatgaaccactattgatacatcattatcaactaaagtccatagtttacactagagttcattctttgagtttcacagattatgggttttggcaattatgtaatgtcctaaatccccaatacagcatcatgcaaaatagtttcactgctgaaaattccctgtacttcaccatttcgtgcctcctcctctcctccacccctgacaaccactcatcgttttactacttctatctttttgactttccaagaatgtcctagagttggaattacagtatgtaggtttccagactggcttctttctagcattatgtactttaagttcctccacgtcttttcatgacttgacagcttgttttgtaaaatcactgaatcagatttcattgtatggctacaacacagtttgtttattcattcacttggtgaaagacgtcttgggtacttccaagttttgacaattatgataaaattgctgcaagtacttatgtgcaggattttgaatgaacttaagttgtccaaagtgactgtacacttttgatttccactagctatggagagttctggttgttcctcatctttgacagcatttggtgtgttcaccgttttgtgttttagccattctgataggtttacagtgatatctcgttgttttaatgtgcaattccctcacaacaaatgattttgagcatctttctcatatgcttatttgccatctgtatatcttattaatgaggtgttcagatgtttcacctttttttttttttttttttttttgctttgtgttgtttagttctcagaattcttcatatattttggacagcagtttttccatcagattattttgtaaatattttctaccagtctgtgacttgctttttccattctcttaacagtgtctttcacagaacagaagtttttaattttaatgaggctcaacttaatttttttttcattagtagattgtgcttttggttttgtatctaagaagccatcattgaacccaggatccctcagattttctcctatgttatctcctaggattcttatggttttgcaccttacatttacgtgtaagatttattttataaagggtataacatgcatacctggatttatttatttttttgcatgtggttgtccagctgttctagcaccactagttggaaaggctatctttgctgttttaaattgtctctaaacctccatggaagatcagtggactgtatgtaggcctgcttctgggctccgtattcttttccatgcatctatatgtgtgtgttttctcttttcaccaacttcacactatttgggttactgtagcttaatgtaagtcctgaagttggtagtgccaaacctcagggagtttttctgaacttcatcatgagaacctggttgagatcattgtagtaacacttggaaatgtgtgagattcccccttagtctggtcttcaaggagtttttaatgttctagccaggctaccctcagcttctagtaatctgtcagtaccatttaagtgctcctcccacttgctgtccccagtagcttctcttccctgtgagctgtgactccttgtgtgttagcctgtgtttctcatttttaaggtggcagttttccctgtgacctcaattctctgatccaccctagaagggttgactttcagtttgttcagcttttttctagctgtgaggacaagtgatgactgcctagctctttccatgttgaaatagaaacccaaaagtttgtttaaagaattacttgttataaaagtcccccattgttaatgtacaactcaatgatgtaagttgatttatcgaattgtgcagccatcagcagagttctacttcagcatattttgtcacttcccaaattcccttgaacctgtttgtagtcatttcctaatccctggtccccatgactgggtctgaatagaataaatatttggaaagcagacttcattatatttatattttcctgtgtttgggactttatatagtggactattgtgttcgttttgtgacaagtagagaagagattgcattctagggatggtttttgggggaacataatagtagtcctgtttatggctctccttgaattggttcatctgtgctggtgactggtattttttaccaaaccttgtctggtgagcacaagaaaaagaatttttaaaaatctactattaaaattgagatgatacattttcacataataatatttgaagtagtgaaccgtctttattttattttatctttttttttggagatggagttatttctcttttccttgggctcgaatgcaacggcgccatctcagctcactgcaacctccacctcctgagttcaagtgattctcctgcctcagcctcctgaatagctgggattacaggcgcctgctaccacacctggctaatgtttgtatttttggtagagacagggattcttcatgttggccaggttggtctctaactcttgacctcaagtgatccacctgccttggcctctcaaagtgctaggattacagacatgagccacggcctgacctgaactgtggggaaaagaaagagatatcagattgttactgtgtctgtgtaggaagaagtagacataagagactccattttgttctgtactaagaaaaattcttttgccttgagacgctgttaatctgtaaccctacccccaaccctgtgctccctaagacatgggctgtgtcaactcagggttaaatggattaagggctgttcagggtgtgctttgttaaacaaatgcttgaaggcagcatgcttgttaagagtcatcaccactccctaatctcaagtgcccagagacacactacactgcggaagactgcagggacctctgcctaggaaagccaggtattgtccaaggtttctccccatgtgatagtctgaaatacagcctcgtgggaagggaaagacctgactgtcccccagcccgacacccgtaaagggtctgtgctgaggaggattagtaaaagaggaaggaaggcctctttgcagttgagataagaggaaggcatctgtctcctgctcatccctgggcaatggaatgtctcggtgtaaagcccgattgtatatcccatctactgagataggagaaaactgccttaggactggaggtgggacatgctggcagcaatactgctctttaaggcattgagatgtttctgtatatgcacatcaaaagcacagcacttttttctttaccttgtttatgatgcagagacatttgttcacgtgtttacctgctgatcttctctccactattatcctattgtcctgccacatccccctctccggaaatgcccgataatgatcaataaatactaagggaactcagaggccagtgctggcatgggtcctccatatgctgaacgccggtcccctgggcccatttttctttctctgtactttgtctctgtgtctctttcttttccaagtctctccttccacctaacgagaaacgcccacaggtgtggaggggcaacccatcccttcactgaaccatttttattctttcagaaatgtgattgataacagtaaagccacactactcaagtgcctgaaatacccctcattgtcttcttcaggtggcaagggctctggaacagccacataaaggtgagggcaatatttttactgtagttctttcattgattggttgattgatttttttctcttagagggttagcatacatttatctgaaattgaaattcaagaggagagacaggcacctgtactagttttctcttgctgcctattatcacattaccacaaaccagtggtttgaaaccacagaagtctggaatgaagtggccgggttctctgatcagagtcatgtgaggctaaaatccgggaatgggctggctgtgttttattcctagagctcaagctatttttccaggttcactacagataatgaaagagttcctattcttgtttgtggggggctgagggccctttttctgtgctggctgtcagcggggagacactctgactccagaggccacgtgctttcctccttacctgtctgtttcatctttcaaccaataacaactcatggagtccttctcaagctcccaccttctctgacttcatcttctccaaccagccacacaaagctctgtcatgtatggagtgatgtgattagatccagttcatgcggtaacctcaccatcttaaagtcatataactggcatataacaacatagtcacaggaatggtgtctcatcaccttaagaggctttagagacaagggtgtggcatgtttggggaccatttcagaaattccatctaccacagtaggacactcacattcccccatctgcaaagtgcatttaccctctcccctgaggtttccagatttcatgtcattaaagcattagttcaacatgaaaaatgtcatgtagaccacatcagatcaaaagtttaaaatcccatctaaaacatccacaccaggtgtgaatgaggcttccgagagtgtccattaagtgcagatccttgacataattcccttacctctgtcgacctgtgaaactgaacaaacagcttatctgcccctaatgtgaaatgatgggacagacatagaataacaactacagtgattctagttcaaaatgagggaacatggaggggataaagaagtcactaacccaaaatagtttggaaatggagctgggcaaaatccagcaggagtttcttagttaggatccacagcctgggactgaccctctgtcctgtgggtctttacctctgggctctctgctctgcatttcttgaaaccattattatttatcattttcctcacactcttttgcgtatggctcctattgcactcaaaatgtttttgagattcatccatgttgttttgtgtgtcaaaagtttgttcctttagccattccatggaatgaatgtatcacagtttattgatccattcttgtattgatagatatttgaatgtttccagtttttcctattatgaataaaactgctatgaacattcttgtataaatcattttctggacatatgttttaatttctcttggataaatgcttaggaattagtgagtcatagaataggtagatgtttagttctgtaagaatatgccagacattttttcccaaagtgtttatactattgtacattccaaccattaatgtatgaaggtgagaaagcttttgctacttccaaagaggcctctctatatacatgtaattttttctaactggagacaggctgatgacttcagggacatgagcatgggatacctgtcatcaccaccaccataaagttgggattcaggaaggaggttaatcatataaagaatcctgtgaccagtatgagcttctctcaggccacacagggcactcaagtgaacagggcatgggggccctggggtcatggtaagaaagtgtctcattggtaaaaccttttcctctggggaggtaaataaatgatttgtttcttcttggtagcccttgaagataaggatggtcaaacaaaataatatcatacctggagaaactcagatcttggtaagatttactggttgggaatccaaagttaatgccaagaagcagccgccagttgggatcaaatgtgagcctatggatcaaggtgcgtactcaaacacagagagctttgtgaaagatgctaccagtagtttttccagggcagagatgggtcctttatttttctctctaatctagcccatatgcttagctgagttttcttcgtatcactttaaatgatgatgtcccttgttcaacaattttctaaacattctttagataataattttatgggcattctttattgcattaggcttaaatttaatgcatcttaaggttttattgcaaaatattgccttgtttcctttttaagatgatacagtttataatatgcaaatttgttgtctgtcccctccctttatgtacatagaaaatgagcaaacaggtggccatgaaacagatagtcatagaattggttcagtggttgtgagtgcagcaacccaagagtgtcttatctgaaataccaccaggaatgtctggacacagtagacaaaggtttttcaactggacgccttaggatacatgcttccaaaaacaaagtagccaaaaagaaaccagagtcacagaatatcagagccagaggaacatttggaggtaattcagtacctcctccttttcaacctacaggggagatagtggaagagaagcagggatgggtctgccttctgtgcccacaattcattggagattgttgtggtgaagaatttcttttatgataaaggagaaataaactcccatcagctttaattcaggcaggtttattgaaaaggtgaagaagcgtcttgcagaagcaaagcatggctaaggcttgtgggctctgtctggacaaatgagcagccgacagtggctgatgctgcccctgactctggagccgtgcggtctgtggttctctgtgagcatctcttctattctcttgcaccttccctcagcctggcagtctctgtgtactcttcaacccataattgagcgaggctgtaccagccccaatgccatgtagcactttatttcaaattagaaaggcatgaaataaactagccctttataatacaactgttggaacaacagttgaaaataacaatatcttgactcctggttgagtgctttacgctgagctttcttttctgaatatgagcacagacttggggatattagtgtcacctggcattattagctagtattctccttttgtttccccataacatcccctcctccttcccacagatccactctccactcatttccatcctgtcttatgccacttggggcttgtcccttctagaatgcatccctggctcccctgtgtgcacacttgtagttaggtttagcattgggggcacccgatggagcctggaagtgagaggaaggtgaggtccgtatttcttccctctccctccctgctctggcactgagtatctggcaatagctgcatctgtctattacttcagtggccactcttccacagccccaattctcagtgggtcccatagcattatttacctttgttcctttagctcccatcaaggaagacccagaggcattctcctcaccaaggcattaagaaatgcatgggtgaggggaacagcggcgtgcgtgtaaaggtcctgtggcacctctcctctgcaggctggaggtcatggcgggagatgctgcatggatttgtcctccctgctgtcagaacaacagggttctggaagagtagaggacaggccgtgggacttggctgtctagagacaaggcgggagggatttccttgagaggcagggacatgtggtggttactaatcattgtgaggtgtctgggatgtaatggatgggaaatctactaagaagtcaacttatgtaataattagaaaagctctagttctgaggacagagacctgttggagtcaccatagtgggaatttttgacctggcatccagttcagatacctggagcttcttgactgaggggagattggatcccttggggaagagtgaagccttcaatgctgccacaagtgtgatccgcccgcctcagcctcccaaagtgctgggattacaggcgtgagccaccatgcccggcctcttttttatatttaaaaaatatcattttatatattatcagggcaaaagagaaaaaccgtatgattaccttgtcatacacagtaaaagcatttggcaaaattgaaaacttttttcatgatttataaaaacaaaccccagaaaatgctcagcatgatgagaacagaaggcaacacttccaaccccattaagggcagatttgaagaacccacaggtaacattatattaaatggcataagattgaatgcttttctattaaatcagagaaaaaagtagaatacctgttgttactcttttaattcagcattatactagagctctaaatcaatgcaataaagtaagaaaaattaataaagtattgaaaagaaagaattgaagctgtctttattcacagataatgactgtgtttgttaacaatgctagaaatctacaaaaatctaccagaactaatcagtgagtttagtagtgttgcagaatgtaagctctcaatataagtggtcttttgtatttctgtatattagcaatgagcatttggaaaatgaaataagaatacaatttcatttaaagtaacatctaaatacatgttgtgcttataaataaattcaacagactgggcaccgtggctcacacctgtaatctcagcactttgggaggccgaggtgggcagatcatgaggtcaggagatggagaccatcatgcctaacagtgaaaccccatctctactaaaaatacaaaaaattagctaggcgtggtggcatgtgcctgtagtccagctacttgggaggctgaggcaggaggatcacttgaacctgggaggcagaggttgcagtgagccgagatcgcatcactgcactccagcctgggtaacagagcaagactctgtttcaaaaaaaaaaaaaaaaaaaaaggaaagtcaacaaaatttatgtaaggccagtacaccaaaaactacaaaaaattgctttgagaaattatgaaagaactaaattagtggggagataaaccttgtcatggatcagaagagttgttatgtttaaaaagtcagttcttcgtaaattgatctccagatccaatgcaattctaataattccaagcggcattttggtagaaatttacaagctgattctaccatttatatggtaatgtcaatgatcaagaataataaaatagcaatattataaaagaataatggcgaatgaattcactacctatttccagaattactctacagctatgaaaatcaagattatgtgttttgttgaaaaaaaaaatggaatatatatcagtggaagagagaatccagaaatagatactcacatgtatgtctaattgattcttaggacatatatatatgtatacacacacacacacaaacgtgtgtgtgtgtgtgtgtgtgtgtgtgtgtatatatatatatatatatatattcaccgttttgaagattatcatctccaaatagggaatatatatatatatatatatatatatatatatacatatacagacacacacaaacacacacacacacatacatattgcagtctgataagataaacagcacattgaaacaatttctcaaaagacttgaatagatacttcagaaaagaagatacatgaatggtcagttagcataggaaaagatgctccactgtttagtcatcagggagatcaatcagtgcaacaatgagataccagtacatatccataagaatggctaaaattaaaaaggctgaaaatagcacctgttggtgaggatataaagcacttggaagtcttatacttgtaggaatgaaaaatggtatggctcctttgaaaatctaacagtttcttaaaggttaaacataacacaaatcagatagacagtcattcccttcctaggaatttacacactgtgtctgcacaatgatctgtatgtgtgtttccagaccaacctgaggggcgggctgctatttctcgtggctcagtaacaagacacagatgaactggggaggaagagagttttgacttctgcaactggttacagggaaacggcctggaaattatcaccagaccaactcaaaattggaaagttttcctgagctaatgtaccttctaagctatatgtgtatgtggaagtgtgcattcatctaaatacataagtgattaacttcttttaatctataactaagtctgagtcctgaagaccttcctctggaacctcagttaaattcagttaatctaaatgggtctaggtgctgggggcccttatcttgtctcctgctaaatcacagaggtttggagagtcccttcagatctccaataaacttgtttgtggaggcctggggagtttcttcagacccccagtaaaacttatttaatactaaatggctcctgttaagaatgccttcgttatttcgtcatgctttaaggcccaggaaaaacctaggcaaaactcttggtgggcttttgttacattccagcctttgtataagggcactggcttctttttttttttttcctcttaatatttaattgaaccactcagtcggtactgaaacagttgttacggaggcctgtgttagtgagacctggcctgccacgtatggatgctcatgatagtttcttcataatagcccaaacgcggaatgatagaaatgtccaataacaagtgaaagtacaaacatacatggtatagccacacgaaggaatactactcagtatttacaagacattacagatggattttaaaattacattgatgcatgaaagaaggcaacacaaaagaacacaggtatcatttcatttatagaaaatggttaaaaatgcaaacggacctgaagtgacagtggctccttggggctgagggttgaaaggctgatgaactgcaaaggggtacaagaaactttggggcatagggaatttcctctatcttggttgtggcagtagttccgttagtgtatccatttgtaaacgtgcattgaattacacattttaaagtggtgcagtctgttgtaccgaaattatgcctttataaagttgatttcatcatcttaatttctccatactagcaattagcagctagaaaatgaaattcaataaaacataatagagattaatagccagaatcattacatgcttaacaatacatgcaatgaagcaggtacaaggcccctaaaagcaattggtgagaaaaattaaagaaggctaaataaatatatatcatgttcattgattggaagactcaattttgttagcatattacatcaacacaattctgattaatatttctagtaggagattttagagaaatttgaaagctagtttcaaaatgtatttgaaaatcaaagaacctagaataagcaagtcggtcttgaagaagcaataagttggaggacttactctgctagatttcaaacctgattttaaagctacagtaattttaaaacagtagtaatggtgtaagtattcataaatatatcaaagtaaaagaatacagattcaaacaatatgcccacatatgtacagttattgatttttttttagtagaatcttttttattcataaaaaatccatcaaaacaaaaaagttttccagccacacacaggaggggtatgggtgggggaaggtgtctgtccatctatccctggcccccagcccatgtggttttggcagcaataaggtgtgtggggtaatgacccctgaaattaaaatggtgtgtgtatgtgaaggaaaggcgggcaaagctatggggagcggtggagtggaaggaacaaaggaggtcagtactgggaacgctgaaggtgggaggccatttcataacattacttgttgatgaaattgccatgaataccttctttgcccatcagcaggcctagcgtcttggcagtcatggtgacaatgacgttgaaggtggggactccaccgatgctcttcatatgaagatccacggtcaattccccatcctgcagcagtgagtccaggaccacagtatatttctggccccccagtgtcagtccattcatgacaaagtttgaccagtctttgccaaccaggacaccaacctcagctggcgtgatgttgaggaaggttttccctgggatggcggcccagatggaaggtgggtccttgttgccaacaatggccgtgtcctaacaggtcccgtccgccacgaggctgtagatggaggtgtccacctggccgttgcgttgctgcaggggctcctctggtcgctgctgttggggccgcctgggctggcgggtgggggaggcggagagctcgatgcaggtgctgtcctcctcgccacgactctgctagctgtgcagtagccctcgctccgccacttaaaaaagaaaaaaatatatatatataatatatatacacacgtgttatatatattgtataatatatatacatgtatacatgtatatatgtgtatatatatatacatggcacacgtgtatatatatataatatatacacgtgtatatatatatataatatatacacgtgtatatatattaataatggcctacatctatattaataatatatattattaatatatatattatatatattaataatatatatacacgtgtatatatattatatatatatatatacacgtgtatatatattatatatatatatacacgtgtatatatattatatatatatatacacgtgtgccatgtttgtttgctgcacccattaactcgtcacttacattaggtatatatcctaatgctatccctcccccagccctcaccccatgacaggccctggtgtgtgatgttccccgccctgtgtccaagtgttctcattgttcagttcccacccatgagtgagaacatgctcgcaccgccgcttctaaatgttttaaaaacaaagacaccaatgcccttcattggggaaatgaaagacttttaagtaaaacaattttgagtgaaataatatttgttgttttaaaaagttaatattaaccactctccatcatatattgaaattaacttaagatgtgaaagttaaattagaaaccttgtaaaggaaaaataggaaatagtttcatgaacttgacacaggaaaatatttcttagactagatactgtagcactcaccacaataagaaatcaagcgaattgcacttcatttttaaaaagcttctccttattatgttgttgtttaacaacttaaacgctatctctagaccaggaataattatttgctatataatacagcaaaaaatatgtatgtataaatggactcattcaaaatatataaagaactcctattacaaagaaattgacaaacagcccagtatatcaatgaatataaaaatttgagaagatattttccataagaagatatctaaatgaacattaggcatgagaaaaccaaattttaggatatcactacacacctggtgtagtttaaaagactgaaaatattaagtgtgtgggaatgtagagcaactgaaaatggcctacatctttcatagaaatgtaaaacaatacaaatactttgcaaaactctgtccaacattttctacccattcaccaagcaactccatccctagctatagatacccaggaaaataagtatgtatcttcacagaaataattgtatgagaatattcatagttacttatgcacagtagttaccaagtaaacctgtctcccatcagaaaaatggatatcaaattgtgtgataatcatacaatcaataggatattacttggccaaaacaaaatgaaacaagggaaaaacacaatcaaacaaattagtggcatatatacccacctgagtaaagagaagtcggccgggtgcggtggctcatgcctgtaatcccagcactttgggaggccgaggcggcagatcacgaggtcaggagatcgagaccatcctggctaacacagtgaaaccccgtctctactaaaaatacaaaaaaaaaaagaaaaagaaaaattagccgggcgtggtggcgggcgcctgtattcccaactacttgggagtctgaggcaggagaatagcgtgaacctgggaggcagagcttgcagtgagcctagatcgcgtcactgcactccagcctgggcgacagagtgagactctgtctcaaacaaaaaaaaaaaaaaaaaaagtcaaaacaagagaacatactaaatgattctatttttttatttatgatttcatgactaccattaagaaaatataacctgttgggaaactgtttctgccttgatgatgttgtacagacaagagataaacagtgaggaatatgcttagatgtattgggaaagacacgggtctgtggcattgtcacaagggtacacgaatactgagagtgaatgctgaaggaatgatccccattggtggtgaccctcaggtgagactagggtgcctgtgtttcagcaaagcctgggcaattggaatgcagggctcctaagattccatgacacccccaccttctaattctgttattgcaactgcagacggttacctggcacgctggccacaatctacctcactcttatcagagtctgcgctactgacagtgctttcagctctgagttgaggcacctcgaaccttgtttttgtggtgaaggatcctaaagtgctgtggggagtgatcacatttttgacaacagtaagttaagaatttcagttacttacatccctcagtcctgattaaacctatttgatttcaccagtttttaacccatcatatgtttgggtttcttctccccagtccctgactccacctcttctgccacaaacgtcagcatggtggtatcagccggccctttgtccagcgagaaggcagagatgaacattctagaaatcaatgagaaattgcgcccccagttggcagagaagaaacagcagttcagaaacctcaaagagaaatgttttctaactcaactggccggcttcctggccaaccgacagaagaaatacagtaagatctataggctcaccgtcatgaaagtgatgaatgatgtcctgtcttctctctgagacactaaatgctctctccatcaaaaataatttcatccttcctgtacttctaggaaaacagaaatgggtattttaacattttgttaaagttggaagacagaggtaccaaagtatttagcaactttccatgtttgcaatcaggtgggggtgggactagagttaaactgccatttattgatttctgacacaggcacagaatgacctgttttctccaagaggctcaatcatgttttcaagaatcctctctgtaccatataagatcctgcagacaaataacatctagtctgttgttctaaatgtctgagactagtgaacttttcttcagttcaagtttctgtggaggcccaacaggcaaagctctgttctagtgactctgagggaaacttggtgatagtagccagtacctgctctgaggggcttcaagaggagtctactcctaatagaacctgtgctgtctataagtgacagcatcaagagcagggagtaggggccgtgcatggtggctcactcctgtaatcccagcactttgggaggctgaggcgggcagatcatgaggtcaggagtttgagaccagcctgggcaacatggagaaaccccatctccactaaaaatacaaaaagtagatgggcgtggtggcaggtgactgtaatcacccctgcctaggaggctgaggcaggagaatcctttgaacccaggaggctgaggttgcagtgagccaagattttgccattgcactccagcctgggcgacagggcaagactgttaaaaaaaaataataataataatgataaataaaaataagaataaaaagcagagagtagcttggtgagagtgaagtcctgcttcctggggcacagagtcttgttgctaaagaggaagaaagatcgcatccgagaatgtgtggagatagcagtgcagtgtacagagcagggactgtgggcctgtctactgggctccatccaagttgcttgtcttgtctgtccctcagtttcctcacctgttcagagggtactacaataatacctacctctgtaaattgctgcagtgaattacatgagctatttcttgtcaatctcctagaacatttattggcacacagtaaacactatctattagttgttcattctgctgtttctaaattaacacaaactttattagcatttgggcatatttccttcatggccttatggtgttatgtgtcactctttatgcttcagatatgattcttaaaatcataactgaagatatgatttaaaaatcaaagattttaaaaatctttcacatacttgtccttgaaattcccagtaaaagggaaaccatcagtcccatagtcctaggggccttcccgactgtacgagaaatcactacttcatgccccagtgcagtgttttagaggagaggctgcaaggcttgggaaagtggccccgcattcagagtcagacctcagggactgtgaattctgactccactttgttgtggttgaatcatcttgtcaacttccttgatgtgcccttgaggttctctttcttcatctctaaattttggaggatcagatgccagaaagtcaggagactgaagagtaaagatgtggaaatccctgtctagaccctggtactggggagagttttgtccttgggatggacctggctcctgtcctgtaggcaatgaccacagcagcatgtccagccttccactgaggcaggcgtgtctgtcttttctcagaatatgaagagtgcaaagatctcataaaatttatgctgaggaatgagcgacagttcaaggaggagaagcttgcagagcagctcaagcaagctgaggagctcaggtgaggggaccccatgggggcaggcaggggggcaggtgtgtaaatctctgaagtacagcagctcggtggggagatgtaagagctaagctgggccaggggaagggcaggaattgccatggcaggctcgctacacacaaatatttatcaaacagagaagaaggataataaaaatgtatgggttgcagttgtttctcagagccttgttttctctttttcaagcaagtaattgttgatgtgaaatttacataacacaaaattaaccaaaggagtgtgaaccacacagcagcattcagtatactcaaaatggtgtgccatcaccaccccacttacccttagtgagaatcacctcctgactgactgcggcttctcattctttcactcaatcaatgttgccttctcgaccctgtcattcttttcttctttcgtcttttcaattcaccccatctgcacctggcctcatttctgtacatggctttgtatctagtggccgcaagatgcactatgtgtattttcacatggaaatgtccatggccagaggaactgaaaggatgtctttttgaaacggaattaggaagacacctacttttgtttacagaagagaaagatgaatggaacatcatcgaggatcttgcaggagccctctctgatacagaggaagcctgtaaaccattttctattctttctcttggccacagacattcctttaaacatgtgctgaccttctgcttcgaggtctccttgaggacattgtctcagaaatctctgttgcaatatttgagcggatcactcaaccctttccactcttaaattttctctaccgtctcaccttaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactgacacagcaccttgtccaaaagctcagcccaggtaaggtggccataggccctgatgacccaaaatcccaggcttatgagagactccagacctccatactttcacaatgacagttgtatcaatggtgtttttttccactaagcttatgtggccatgacatgaccaggacttcttgggtaagaacggagatgggaaacccatggggttggaggtcacagtattgcaagtgtccctcctcccttgatggaaggtggtctttggagtatgaggcagcatctgtctagttttaaaggacaggaaggaggctgcgatgggagcaggcttgttagagtgaaaagagctctggactaagaatgaagattcccaggctgtcttttcggcaatgttcttagtaactgtcagagagtgaatgacttgtccttcctgagtttctctctctccgtggcagacaaattgtctcttgcaagggtctgaagcattcaaatgtgggaacacttacaactgctttccaaaatgagatgaaggccctcaccgtgtgatgttggagaaggcactttatgtgggggcgttttgtggtaggaagtgcttcagactggagcactccccatggatagaatgtccctgaataacacagcagaagccacttggaggcttgaaatcttctgatgcatagaggactgtgggacaagtttgtctgcttctaagagaaagaattaggtttgaaatgcaaactgtgacgggacaccaagcctgtgcctgggaatcagatctggcaggatgggggagacagctgccaatgtccagagagaggctgcacaagcctccagtgatatgggaagcaaaaggtcttttcaatatttggccacatcttgatggtggccctccagatcagaaatgcattgcctgatggatcaggaaaccatgccagggcattctgttaaagataaaacatgagagttttcagttgaacggtgacccatgcctagatgttcatgtctctgttgcacattgggctgactgtgcttgcagactgtgaagtgggaaatatctgaacgaacacttctgtatttacagaaaatgacaacgatgacgatgaagatgttcaagttgaggtggctgagaaagtgcagaaatcgtctgcccccaggtaacactgaatactcaggaacaattaatggatggtaacatatgaggaatatctaggaggcacaccctctctggcatctatgatgggccaaaaacccgcattcgcttggccacagtatgtgaaatataacccagcttagacacagggtgcggcagctgtcatgtttctctgtgtgtgccgagtgtcatgtctgcaccgtacagggatagctgagtcttcatcctcctcagctcctatctgtccagtgcaatgaacagcagctgctctcttcctctctggttcccatggcagccatgctctgttgcagagagaacaggattgcatgttccctcttaatgggaacgtccattttgctttctgggaccactctcttaatgccgcctgtcaaaaccagctaggactccctggggtccaatccctctgtgtttaatcttctgtcatctctgtcccacctggctcatcagggagatgcagaaggctgaagaaaaggaagtccctgaggactcactggaggaatgtgccatcacttgttcaaatagccatggcccttatgactccaaccagccacataagaaaaccaaaatcacatttgaggaagacaaagtcgactcaactctcattggctcatcctctcatgttgaatgggaggatgctgtacacattattccaggtagcctctgttttccttgtgtctcatacctctctctaggctgaggaagataaactctgaagacaggctctatcaacacaaattcatttgaataaaaaactgtgatgggtttctaaacagatatcagggagtttttttgtccttctcagctaatgtcatgcctttgtctgccagtccccagtatcaagttactcaaccccaggcaagtgtgacaatctcatagtcacctgagtgcaggaggtgcacaggccatatctgtcaggcctcctagcttcgattcagtatctcttgtcatctgtgattaagtcatctgtccctgaacaatgcccatggagtttctatgcctgtttaaggaagctggcagccttgcctttgtatttggaaatatcgttcctcaggcttcactgctctcagctttcatctggatctcctttaagtcagcttgcttagctgcacagtcaccctgaaatcaggacggaaacttttcttctttactttgctgatatatttccataaagcaaggctggaccctggttctccaccctgtcaatgcaatggctgatccaatgtttctttgtagcatcgtggattttttttttttttttttttttgcgatggagtcttgctctgtcacccaggctggagtgcagtggcaccatcttggcttggtgcaacctctccctcccagattcaagtgattctcctgcctcagcctcctgagttgctgggaccacaggtgcacaacatcacatctggctaatttttgtatttttagtagagacagggtttccccatattggccagggtagtcctgaactcatgacctcaaatgattcacctgtcttggcctcccaaatcacagattctttttaaagcaagagttgttcaaatttatctatcagtcgtgtttcatgtatagatgcctctaaacatttaatgtccatgttacctggtgatataagtccgtattgcagcaacactcttagaaaattgtttgaccaatttttggagatttttttggggaaaaaattttgtttaactttgactcaggcagggaatatgtcattatggtctacacgtagagggagattttggcctgtgggtctggaaagcagggtcatctaattctcaccaaagttaatctaggacaccctagaatattcctgtcagaatccttattcttgcactgagaatagttatgtccttgtgctatgactggacagtgatttgttcctatgtgaagtatgaattgcttaatgtgacctgcttctctgaatttatttacagaaaatgaaagtgatgatgaggaagaggaagaaaaagggccagtgtctcccaggtaatgttgtggaattgttggctgttaattcagtagtgacatctggagattgtagatttagggaaaatgaggaagtgatgaatagaactatttcttccattcacccagctacaaattgtgctgatttacaatgttgtatgttatttgtggcacttgtattggttttaatttcatagtcctctcaagataggaacttgccatcagatgagccaggtgaactagccaaacagggttttcttgttgatcttttcaaaaaaccagccctggattcattgattttttgaagggttttttgtgtctctatctcctttagttctgctctgatcttagttacttcttgtcttctgctagcttttgaatttgtttgctttgcttctctcgttattttaattgtgatgttaggatgtcaattttagatcttttctgctttctcttgtgggcatttagtgctataattttccctctacacattgctttaaatgtgtctcagagattctggtatgttgtgtctttgttctcattggtttcaaagaacatctttatttctgccttcattttgttattttcccagtagtcattcaggagcaggttgttgagtttccatgtagttgtgcggttttgagtgagtttcttaatcctgggttctaatttgatggcactgtggtctgacagtttgttgtgatttccattcttttacatttgctgacgagtgctttacctccaactatgtggtcaattttggaataagtgtgatgtggtgctgagaagaatgtatattctgttgatttggggtggagagttctgtagatgtcttttaggtctgcttggtggagagctgagttcaagtcctggatatccttgttaagcttctgtctcattgatctgtctaatattgacagtggggtgttaaagtctcccattatgattgtgtggagtctaaatctctttgtaggtctctcaggacttgctttatgaatctgggtgctcctgtatagggtgcatatatatttaggatagttaactcttgttgaattgatccctttaccattatgtagtggccttctttgtctcttttgatctttgttggtttaaagtctgttttatcagagactaggattgcaacccctgcctttttttgttttccatttgcttggtagatcttcctccatccctttattttgagcctatgtgtgtctctgcatgtgagatgggtttcctgagtacagcacactgatgggtcttgactctttatccaatttgccattctgtgttttttaactggggcatttagcccatttacatttaaggttaatattgttatgtgtgaatttgatcctgtcattatgatattagctggttatttcgcccgttagttgatgcagtttcttcctagcgtcaatggtctttacagtttggcatgtttttgtagtggctggtaccggttgttcctttccatgtttagtgcttactttaggagctcttgtaaggcaggcctggtggtgacaaaatctctcagcatttgcttctctgtaaaggatttatttctccttcacttatgaagctttgtttggctggatatgaaattctgggttgaaaattcttttctttaagaaggttgaagatgctggagaggatgtggagaaataggaacacttttacactgttggtgggactgtaaactagttcaatgattgtggaaggcagtgtggcaattcctcagggatctagaactagaaatactatttgacccagccatcccattactgggtgtgtacccaaatgattataaatcatgctgctgtaaagacacatgcacacatatgtttattgtggcactattcacaatagcaaagacttggaaccaagccaaatatccagcaatgatagactggattaagaaaatgtggcacatatacaccatggaatactatgcagctataaaaaatgatgagttcatgtcctttgtaggggcatggatgaagctggaaaccatcattctcagcaaactattgcaaggacaaaaaaccaaataccgcatgttcttactcacaggtgggaattgaacaatgagaacacatggacacagaaaggggaacatcacacactggggcctgttgtagggtggggggagggaggaggggtagcattaggagatatacctaatgttaaatgatgagttaatgggtgaagcacaccaatgtggacatgtatacatatgtaactaacctgcacgttgtgcacatgtaccctaagacttaaagtattaaaatatatatatctgtatatatatatatatacatacacacaaaaaataataaaggaaaactatacatatggaaaaaaaaaagaatgttgaatattgctcccactctcttctggcttgtagggtttgtgccaagagatctgctactagtctgatgggcttccctttgtgggtaatccgacctttctctctggctgcccttagcattttttccttcatttcaaccttggtgaatctgacaattaagtgttttggggttgctcttctcgaggagtatctttatggtgttctctgtgtttcctgaatttgaatgttggccttccttgctaggttggggaagtcctcctggataatatcctgaagaatgtttcccagcttggttccattctccccgtcactttcagtacaccaatcaaacgtagatttggtctttccacatagtcccatatttattggaggcttgttcatttctttttactcttttttctctaaacttctcttctcgcttcatttcattaatttgatcttgaatcactgataccatttcttgcacttgatcgaattggctactgaagcttgtgcatgcaccacgtagttctcgtgccatggttttcagctccatcaggtcatttaaggtcttctctacactgttcattctggttagccattcgtctaatcttttttcaaggtttttagcttccttgagatgagttcgcacatcctcctttagctcagagaagtttgttattaccgactttctgaagcctacttctgtcagctcatcaaagtcattctccatcctgctttgttccattgctggcgaggagctgcgatcctttggaggagaagggatgtcaggtttttggaattttcagcttttgtgctctggtttctccccacctttgtggttttatctacccttggtctttgatgatggtgacctacagatggggttttggggtggatgtcttttttgttgatgttgatgctattcctttctgtgtgttagttttccttctaacagtcaggtccctcagcttcaggtctgttggagtttgctggaagtccactccagaccctcaaacagggatttcttggtgttgcctattctctcccatgtgtttaaatccagggagaggtgtatacatgctttcttcctatttgttggtagtatgttggctagtatttttgcaagaaaagaaattgaaaaagtaaatatattatatcaaaatattgggaaaatggggcccttaatacacaagatctgtgtctgcactgcgtcaagaactctcttcacttgaatgctgcatgtaaaattcaacccaatttatgcaaagtagttgaagccctgtgtcagttctctgtgctgcaagtcatgatggtagtttacagggagagtctgggtgccctgagttggctcatctgtggcaaatgtactgagcacatgctgcccatttttgctgtgtccccagagcagtcaccctccaccctgtatttagaaggatagttttatttctcttgaaggaaaaatgcctttggtttctgtgaccactccattctgtctcccatcagatcatctgggaggttttgttgtctaatgtctgttggttaaatcttctatcatccctgtcctgcctggctcatcaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagtgagtactccattgtgaaggtgataaagctccagttcatggcccaggtagaccccataatctttgggccttgtgccccttgttgggctgagatttgccatcaccgtgggctgaacctatatatcaatgtagatttcaatcactctggagtcgagtctgaagcacaggcatggggtgggtcagtgagctttgctctcttcctagtctcaggccatgcccgtgccaacctggactgactgtcacgacattgaactcaaggcaggtgtggcaaactcacaccaaactatgcagcacatgcccaggagctgtctgtcagctcagctcatctgaattaaatgtctcttgccagctacaaaattccttatgagttttgttcccaaagcatgtctgtgtggttctttacctgcccaaggccagtgtcacccttgtctacttctcagtgaaagatgtgacccaggtttcactgaatttattcccattttctgtgtcttctaagtgcgcttgttttagctcatctgtccatcatgttcctggtacgttttctagataaacggctgacttttcacccacaaaagccataatagctgatgcttctgtgtagaaccaagtttcattttgactcaagagctggtacattgcaccccttcatcaaatctctgtgtccacaatctcataaactatcaaattctgggtatttaatgagagaaagcttaatattgaagtatctctcctatgaggtgttagaactatttgcctacaatttattggggaaaaaattgctcatttgtgtacataaacctaggacagagcacatagggaagataacattccaaaacaggggaattttgcccaaggctcatgaaagaacccaagccagttttctcaagacttgacctcaggcctactggaatatttctctcaaagtctcctgttctcacactgacaagactgatgtccctgtgttaggattggacagaggaatgtttctgtgtgcaaggaagaactgcttaatgtaagagggcccatctgaatttatttgcaggacatcggtgggatcaagtgaaaaaggaggaccaagaggcaacaggtcccaggtgagtctgagaaattgtggacagttaatttgatgttgacacctggagatgccaagtccagggaaaacagtacatgctgaaaataatgattttgtcttgtcagacaagtctgaattatgcctactacattgctttttggttctcattagagtaaatgtttaggtttccatttcttcctacacttatcatttactaacctagtgaaggttgaccatacctcaaaagctgtattctcatggtaactgcagggaaacttgagcacattttatgcaaaattattgaggacatgcttttcatgatcactgttcactgtgtgtcctgagagcacaaatacagagtgtcctttgattccctcatcagtgtgtcacctgaccaattcactgagctcgctctgtgtgtgtgtgtgtgtgtgtgtgtgtgtgtgtgtctttctctttcatccttttctacctggccctagtctatcccaacataaaggcaataatttgttacctcattaatggatctgtcctttttcttttcaaactcttccttatgttagccatgaaatctagctgggactgtgtggtttctgattccccctggcttattctttactttttcccacttttccaggctcagcagggagctgctggatgagaaagagcctgaagtcttgcaggactcactggatagatgttattcaactccttcaggttgtcttgaactgactgactcatgccagccctacagaagtgccttttacgtattggagcaacagcgtgttggcttggctattgacatggatggtgagtacctttctatgaaggtgataaggatccactgagtcttctggttagggtcatattcctactgcaagtggcccttactgagctgagagatgtcattgccacagggaggacctataggcacatgtaggttgaatgaaactctagttccacttggaagcccagacaagggatggatcagtgagcaaggctctcttcctagtctcaggccatgcctgtggcgccctaatcctactctcatgacgttggacctgggcagatgtgacaaattcacacaactctgattttgtctcaattttgtagatcttgtagatttcatccttcactctaatttcagcgtctaaaatcctcgctaccgtgaacaatctgagtatttgatgagacagggctgaatagtgcagtttttctcctagcaaccatttgggggcatttgctttaaatcgattggaaaaatatggcataaccatttgcacaaacttgggacaaatgatattgggataacgatctaccagaatagggaattttacccacagtttctgggacaaaaaccaaggaatctctatggtgatcagccttcaggcctcttgaagaatatctctcacagtgtcctattctcatgctgaggagcctgaagtccctgtgtgaggattagacagtggattgttatgtgtgtaggagaaccagcttaatatgtctgtccatgtctgaacttattgcagaaattgaaaagtaccaagaagtggaagaagaccaagacccatcatgccccaggtaactttgagcaattatggatgcttaattgtgtgttgacacctggagatgccaggtccagggaaaacaagagtgtgttcaatttcatgttttcaacgaaggttgaattactcctcctgacattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgaccactgttcgttgtgtgtcccgagcgcactaactcagagtgtcctttgaccccttcatcagtgtgtcacccggccaattcgctgagctcactttctcctctctctctctctccctctccctgtctttctctttcattcttttctacctggccctggtctatcccaacataaaggcaataattcattacctcattaatggatccgtcctttttctttttaaacagttccttatgttagccatgaaatctagctggggctgtgtggtttctgattctccctggcttattctttactttttcctacttttccaggctcagcagggagctgctggatgagaaagagcctgaagtcttgcaggactcactggatagatgttattcaactccttcagattatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccgcaggcaggacctatgggcgcataaaggttgtaatgaaactgtagtctcagttggaagcctagacatgaaatgggtcagtgagcaaggctctattcctagtctccagccatgcctgtggcaagctgagcccgctctcagcacattggacccaggcagatgtaaaaaattcacagaactatgatttggactcaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatggggatatttcacccttggttctgagatgcaaaccaaagaatatcatgaccagctttcaggcctcctgaagtatctctctcacattgtcctgttctcatgctgagaagcctgagatccctgtgtggggattagacagtggactgttatgggtgtaggtgaattggcttattttgtctgtccctgtctgaatgtattgcaggaattaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttccagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatcactgtatgctgtgtgtcctgagggcactaactcagagtgtcctgttactccctcatcagtgtgtcacctggacaattcactgagctcgttctctctctctgtgtgtgtgtgtctgtgtgtgtgtgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttagttttttaaccacttccctatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaattggccattactgagctgagagatgtcattgccgcagtgaggacctataggcacatgtaggttgaatgaaactctagttctacctggaagcccagacaagggatgggtcagtgagcaagactctcttcctagtctcaggccatgcctgtggcactctgattctactctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaaattgattggaaaaatatggcataactgtttgcacaaacttgggacaaatgttattgggataacgatctactagaatagggacactttacccacagtttctgggagaaaaactgaggaatttatatcatgaccagccttcagacctcctgaaatatatctctcatggtgtcgtattcttatgctgaggagcctgaggtccctgtgtgaggattagacagtggattgttatatgtgtaggggaatcagcttaatgtgtctgtccatgtctgaatttattgcagaaattgaaaagaaggggaaggggaagaaaagaaggggaagaagatcaaagaagaaaagaagaaggggaagaaaagaaggggaagatgacaacccaccatgccccaggtaactttcagcaattgtggatgcttaattctgtgttaacacctggaggcaacagattcagggaaaccagagtgtgtttgatgtcatgttttcaacgaaggctgaattactcctactgtcattgctgttggttttcattgcagtagatgtttaggtttccatttcttcctccccttatcatttactaacgtaccataggttgaccatacttcaaaagctgtactctgatggccactgcatcaaattttgagcatattttatggaaaactattgagctcactctttttgtgatcacagtttgctgtgtgtcatgagggcactaactcagagtgtccttttactcccttaccagtatgtcacctgggcaattcactagctcactttctctctgtctctgtctctgtctctctctctctgtctttctctttcattgttttctacctggccctgttctatcccaacataaaggcaataaattttttttttttacctcattaatgaatctatcctttttcttttctaaccacttccttatattacttctgaaatctagtggggctctgtggtgtctgattttccctggctgcttctttagttttgtctccttttccaggctctacggcgtgctgatggaagtggaagagcctgaagtcttacaggactcactggatagatgttattcgactccgtcaatgtactttgaacaacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagctcttactaagccgagagatgtcattcctgcaggcaggacctataggcacgagaagatttgaatgaaagtacagttccatttggaagcccagacataggatgggtcagtgagcatggctctattcctattctcaaaccatgccattggcaacctgtgctcaatctgaagacaatggacccatgttaggtgtgacacgttcacataactgtgcagaacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacattttgccgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttctggattgttttttacattcagtgttataatatttgattatgctgattggttttggtgggtactgatgcgaattaataaaaacatttcatttccatgtttattttctaatctcttccacattgtaggctatgtttaccatacgtagcagaatgtatttacatttcttggttctagtcatttgtattcttcgtgagtgtgagtgtgtgtgtgtctgtgtgtctgcgtgtgtgtctgtgtgtgcctttggcatttaggaagggttgtatagctcatgttaaatattgcactaaaaatgtttttgatggttttcctccctttgaactagacacacttctaatatttggtttatagttttaaattataactttcagcatcaaatatttccatacaacagtcaattacatgatgtgttttctttttcctacctcctttacctgccccttctcataatagtatttgaacctaaacatataccgttgacattctgtgattatcatcttgcccctaccttggttttggtttttggtgcagttccaggctcttggtgtctttgtttgggacaccaagagcctggtactgccacggcaccagctggtaagaattaggcttttttggccgggcgcggtggcttatgcctgtaatcccagcactttgcgaggccaaggcgggcggatcacgaggtcaggaaatcgagaccatcctggctaacacggtaaaaccccatctctactaaaaataaaaaaaattagccgggcgtggtggcgggcgcctgtagtcccagctactcgggaggctgaggcaggagaatggcctgaacccgggaggcggagcttgcagtgagccgagatcgcgccactgcactccagcctgggggacagagagagactccgtctcaaaaaaaaaaaaaaaaggctttttttttccctaagggttaacaacaaaccagccctttggaaagacttgcttcaccactgttaccaaccaacggcctgatgctttccctcagttttgtgattttgacaaaacaagcaagcagcattccctcctgataagagaccaccgacctaggaatgattctggccagactagagaggatgcacagtgagggttttcatgtcctctgcttcagcttttgatgtcagagggccacaaactccactctcagatgattgctaatgccaccattttatgaacatggaccccatggagaggcacgaagctcaattgcacttctgcacatttttcctcctataaatattgctattggaatattatttggtacggctcccgtgaaagatacatttgcagaatgtactcaaattagaagcatcatgtaaagcctataatgtagcgatagtgcatcaacttccctacactatagaaatatctgcggtgtagacatttccacaatgaccagatatgtgtacaacaaaggtggctgcagcattctttgtaatcctaaaacaatgaaacctacctcatctcaaaaactttatttttttatttttattttttttttgagatggagtctcgctctgttgcccaggcgggagtgtagtggtgcagcctccactggtgcagcctccactgcagcctccacctcccaggttcaaatgattctcctgcctcagaatcccaagtacctgggattacaggcacatgccaccatgcctggctaacaaaaacattttgaaaagggttaaataaatcatgcacaaactgaggaaaaatactcttcaaaaatgatggagaggatcactatgatgatgaatgattccactggtcacattattgatagagcaatcagtaaatccaggcacatcctcgggatattactgacctcctattattaacatatgaaaaaatggaggcatgtaaattactcgtttaagcgtataacggactgaattagaattttatcacaccagaagtgggttcctaggtctctgtttcaggattcctgagttacacacatataaacccaggatttcaggagatacccggttaagaatccggtcggggaggtgggctggcccttgacatggataagtcacaaattagtggcttaggactccaggaagataaaatcttccccatttatctagtgattgacaatgcatgaatactttaaaagctcaaacaagcgtccctgggtgggctcgaaccaccaacctttcggttaacagccgaatgcgctaaccgattgcgccacagagacaggtactgtcagttctactgggcgctataggaagggcgcacgcacgaaacttcctccgtcccttgcaacctcagggcccgcccggcaggacgactgagcaaggccttggaaaaccggagagattggagcggtaagtcgcgctggtcacgttggacacctgcgcgttgggagattctggagccagaaggatagccgaatggccttcgcccgccctgcccctcgcctgcttcagaaaccccccggaaacgtcccggttgagaccccggcccgagccgcctgggggccctagggaggctgaacgcccggtggctcccgggatggctcttcccgttcttcgcgccgccttcacccagtgagggagcctgtgccctccctgcccagtcgcttttggggccgctgcggagcttccgctgccatcttcggatcctgtgttccgcacgggggctccaccagggcagggatcgtggtgagggtggctcgtgggtccccctcgcggggagcagggtctggcactcaccagggcgcaggactaggacttgtcgaatgaatccatccttttagcttttagtcctttgaagagccttgagaatggaaatcatgagagatttttccatggggaagttccttttacaaagcatttatttacgtggacttcttggcaccccgcggggcggcaacgggcagggcctccagtgccccttctgcgccgtggagccgcgggggctcagctgggcggtggtcgggtcctgaggccggagggcgggagcaggggaggggaaaagcaaaagcggggaaagaagccggggagcggtggaccagacgtccagacctcctgaaaggctggcggggaggcacaggcgggatcttccggaggtgagaatttttttttattatagcagaatggggaggaattgaggggaaaatggagatagaacctgaaagagccccaaacgccagaacctgtagctccccaagaataagatcttccagaagaactagacccaaaactagccgttggggaacaccgaaatccttggaggagcaacatccgcatgaccctctgtgttcctttaggcaaaaggacttgcttccattgtttgttcaattgtttgtgtttgttaaataaataaaacgattttcatgtatctttgaaattactttggcgctactattttatgattgcaaataattcggcagtgatcattcttgtacacttctcattggccatttgtgtatttctatagggtagaggcctggagagcagttgctccagcatagggattacacagtttttgtttgtttgtttgtttgtttatttatttatttatttatttatttttgagacagagtctcgctctgtcacccaggctggagtgcagtggcgccatctcagctctcactgcaacctccgcctcccgggttcaagcgaatctcctgcttcagcctcccaagtagctgagattacaggtccgcgcgagccaccacatcgggctaatttttgtatttttagtagagacggggtttcaccattttggccaggcaggtctcaaactcctgacctcaagtgatctgcctgccttggcctctcaaagtgctgggattacaggcatgagccaccgcacccagcgattacatgttttttttttatatatcattctattttctttccttatttggcttattagctgtaactctttcttttgttatgtcagtgatggctttagggtccctagaatacatctttatccgtctgccatcaagtgacattatacctccccttctggcctttatgctagtgttgtcagggaatttgattttggacatgttataaaccccaacatccaagtacgtacatagcgattttcagtcgtctccatttctttgtgtaggttcagatttctgtttggtatccttatccttaggcctggaggactcctttaatatttcttgtagtgtggttcggtgaattctgtcatttttttgtatgtctttaaatgtcctgatttcagtcacatttttgaaagatatttcaatttggcatagaattctagaataactttttttctctcagtactttaggatgttgccactttgacgctttgtcattgacatatctttcctgtttttgtaaacttggcataaagtgggtttcctgtacttgttatatgatttttggattgtgtattcaaattaaaagtattaaattaaaattaaaatggcctgggcgaggtggctcacacctgtaatcccagcactttgggaaggggaggcagaggatcgcttgagacccagagttggagaccaccctgggcaagatagcaagaccctgtgtgtgtgtgtgtgtgtgtgtgtgtatatacacataaatatgtatatatattatatgtatgtatgtatatataagtcctacagtcaccttaagttccaccaacagtgcacttaaagtaaaatgtgcccaacctgaggctcaaacctacctgctggcacgcaatttgtgtttgtgagacaatctcaacagcatttgctttttctagcatagtggttttcctgttttcctcacatgtgaatgtcttcagtgcaaaacctgtcagaattcatttcctttgctaaaatgttttaaaataactcttacttcaagtaagtgcattaaaaacaaacttctcagttgcatccctggaatccatggaaagtccaggagagacaatcaagtgctacaggatcaagcccaaacagaacaggactaggcatggcttcctcactaggagtcaggccaaagtcatctcctttggtctccaatggaggccagaactcggttcacctgcaacgggaggacctggcccagaagaggtggccttcatcttcatggtgccttcagataggaaatctaggatttcttttcttctctttgatctacttccaactctccctttctatttatttatttatttatttatttatttatttatttatttgagacagagtcttgctgtgttgcccaggctagagtgcaacggggcagtctcagctcactgcaacctccgcctcctgggttctagagattctcctgcctcagcctcctgagtagctgggattacaggcgcctgtcaccgcgcccggctacttgttgtatttttagtagagacagggtttcaccatcttggacaggctggtctcgaactcgtgacctcgtgatccacccacctcggcctcccaaagtgctgggattacaggcgtgagccaccgcatctggccctccctttctatttcttcaagacctttttcggatccctcctgcgcaggacctaaacgggcggtgcccttacccactggtccctccctgcctggtgtcttcggagccctagctcacccggaacgttactgcccgccggtgacagcgagaggaccaaagaggaccaaagagggcagcgggtgtggtgggaaccacagagtcaccgcgcacctgcgcctcgcgggctcctcgcaaattgaataaacgccccctgaagcttctcttcaagtcacagggaaggggaaggtggctgccgacccggcgggagaagccggccctgcccctggtccttgaagacaggtttggccaggctgattttgactggtaggcccaaagaaaagcctcaagggcagaccaaactccgacaggctccgagattaaggctttcaaacgtctgatcgttttcagcttggtcagtaaaatcgatcccgcctttatcaggagattcctttgccaaagttcagagaactggggttcccgctgcttgccacacagaaaaccgatcactgagacggttattgccaaggaagaggctttaatagggtgctgcagcggaggagatgagaactcagtctcaaatccatctccctgaccaaccaaaattagaggcttagatggcagggaaagaatgtgacaatgtgtaagaaaacaggaactagaccaggcgcggtggctcacgcctgtaatcccagcactttgggaggccgaggcgggcggatcacgaggtcaggagatcgagaccatcctggctaacacggtgaaaccccgtctctactagaaatacgaaaagaaattagccgggcgtggtggcgggcgcctgtagtcccagctactcgggaggatgaggcaggagaatggcgtgaacccgggaggcggagcttgcagtgagccaagatagcgccactgcactccagcctgggaggcagagggagactctgtctcaaaaagaaaaaaaaaaaaagaaagaaaagaaagaaaacaggaactagggaggggcaaggaagcaatcaggatgaatgaggggtccggcgtctcattgtctgggtgactttcagttctttgatatcttttttgagaggcctgaaggaaggaactcaaataaaacaaatatcgagtttcaaactttcagatcagaagggtccatttctatgtttatccaaaaatctacgtatgggactattgggtgggtttcagaccaagaaagagtgtgcatatcaaagtctgcggttaaccaaagagaaaacataattttccgaccaataggatgtatgggggtcaaagaacgaccagcctacagtactgtttattggcctgagcatacggaaggatgaagttgcaccagcgaaatgggattaagctgcaggtgcgggctgggcgcggtagctcacacctgtaatcccagcactctgggaggctgaggtgggtggatcacttgagatcaggagtttgagaccagcctgaccaacatggtgaaacctcgtctctaataaaaatacaaaaattagccgggcgtcatggcgggcacctgcagtcccagctactagggaggccgaggcaggagaattgcttgaacccgggagatggaggttttaatgagccgaaattgcgccactgccctccagcccgggcaacagaccgagacaccttctcaagcaaaaataaaaacaaaaagctgcaggtggaaaaaaaaaagtctggattttggttcagagtccctggggccttcctcagtagttttctctttccttaaaaaaggaagcttgtctcagtctctgcatctctctgagtccttttggagattgaggatggtgaggtctcagtgcttggcccccttctaactctgggtacctcccctcccgtgggtcaacctggtccagtgcacaggccccagctccgacgaccatctcccccctaccctttgctcccagcaaaggccatttctaggtcagtcgtgaggtacagccaggacagggcagctcgctccgagatttttggctctcgaaggccttgagcgctgtggttctgcagaacgctgtctgtctcttgtggaggaactgacacccgctggagaaagtgtggagggaagcgagggctgcacctgcacgcaggagctgaggcaagcggcggttcccagctctcagtgcaaaagacatttgtcatctgagaggctggactcagttattataattttcaattttgtcaataaaaaccgaatggaaatttgttttcttacttgtagaaacctcctcacaagacctcccatcttacattccagggagacttagcagggtattccgccaagacataggttagactgcggttctgatctgcaggcctcgatgccctgcgccggggcaccagggcacgggcaaagccctccccctacacaaagcaagggtgttatgcctacaaccgaacggggacactaagagcccccaacatgcacggttttcattccaaagaaaaccaccagttctgagtacaacttccacctggctctattaactgagtacacgtttccccagcacagaaatcctacaaactcccgtgaatgctgtggtgaaaagcaggagctgccagggcaagatggatcgcacctgcaatcccagcacttcagaaggctgggcggaccacttgagcccaggaggtggagcccagcctgagcagaatggtgaaactgctacgaaaaaagaaaaagaaaggaaagagaaagaaaagaaaataaaaaaaaaaagagaaaaaactagccgggtgtggtggcgtgcggttgtcctactcgggagcctgagatgggaagatcgcgccagttctccagcctggacggtacagcgagacttgtcttagggagggggggaaaaaacaacaaaaaaaacagaggctaagaggtaactccgaggatgacagaaaacaccagagtttttaagagatgttagaagccctgggagcactgaacaaaccagaaagctcccgacccttgatccctgagctccacctagcaagtaccgcggcagctaacctgggagaacaccccaaccaacagagactgaaattcgcctcccaagagagtaagtggatagttctaagctgtccccaaacatggcctcacaaaggaaaactaaccgttgcgaacggaaacaactgaccggacagaacacagccacaaaacacgagcccgcaccctgagttacaaaaacacttacggctcacctactattcgcaccacagaagcaccaggggaaagcgcgaacgcagtcccctactatcacaagttatgcagtcgagttcctcacattgggggaaaatggcaggggtcagtacacccggaacataacggataagcctcgccctgagaaaaccaccttcgtgatcatggtatctcccccgccaagtaagtatgagcttttgcacctccgccccgccacagcctcacacgcttcaccctttacacgcacggtcacttgccccgcgcacgccccccccccccaccccccccgcccccagccctcctagccctgacacatagctgggactctcaggtccgaccagcggtcctgaacccgctcccacggcacgggaactccttagtggcgaagcagcagcccctgcgctgcctcatctacatagaaatcgccctatccgtgatgtcaccgacagcgcctttcccagacaccgtctgctcttccgccccaccctccgccgactcagccgatcaacccgctgccggagctggcggaggaagtgacgtctgtctctttctccttttcctcctgccattgtcctttggggaggtgcgcagagatcccacgtctggtctccccctaagactgtggtacttgatctgtgtcctgcagagaacccttctggcggccaacaggaagcttgtgcacccttcttcagataatgtcttttaatgcgcagacttgaacgtttaggattacaaggaaaaccggttcctttcaaacctgtttatctttgtgatgtagcattccgtttcaagttgaaagccattcaatgtcagagagaaaacatatctatgaaaccagagaggctgctcagatgggttgcaaactagccatccttactggttttaccactagaagtgttacaaagacagttgtccaattttatgaatcttgaagggttttttgttgttgttgttatttcaaatacagtgtaatacaaaaatatgtggcccccgcagagacgattggacactctcaggcatggtgatggagtttgtcatctcttccacggccatctcagaaccttagtgcttacctcatgttagtattttatattctccaaagacacaaagataatcccaatttgacaaaacaaacaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacatgaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattcctggatactgacagggagacacattgtccaggtaatactggaaaaatactttctatagtgtaaaccacaaataaaattccaagcccctcaactatttgaatgcacccctcctctcagccagggtcattccaaagttaacctgaaaaactggttcagaccatgatgggaagtaggggtcagatatgcctcattataccctccttcctttggaattcaggcacaactgaccagcacatccgaccaggcccaactgacattacaacagcgatctcaagactttttgtagcaataagacaccaaactccaggctgactctagtgtagcattacatgacagatagcaggccctgaaagaaatgaaaatattttaccctaaaatacattttttatcatattttgaaatgtccctacaaagttgtctcttgtggggaaagtctacatgctatagggaatccctttccaggccttttccctaatctaggcacctttttaagtctgataagaaacatttacaatcaattctctctgaagcctgctacctggaggcttcatctgcataataagaacaaccccttaacacagagactgccttctatggattccaggtctttagataaactctttcaaccaattgccagtcaaagtatcagaaaataacggctggtaactatgtaattatgcatatatatgagtagaattttgggggtggacacagtggctcatgcctgtaatcccagcactccctcaggaggctggcagattgcctgagtccaggagtttgagaccagcctgggaaacatggtgaaaccccatctctacaaaaaaaaaaaaaaaaaaaaaaaattagccaggcatggtggtgagcacctgtggtcccagctactcaggaggctgaggtgggagggttacttgagcctgggaggtgaaggttgcagtgacccaagcttgcaacactgcacttcagcctggatgacagaggaatggaccttcactagacactgaacctgctggcaacttgatcttggactgaccatcctccataactgtgagcaataaatttttgttgtttataagttactcactctgtggtattttgttatagcagcacaactggattaggacatcaacctgaccttaagaaatcatctcattcagtcttggctctggtgggaaacaaggggcacactcggatgtgtgatttaaagagagttgtgttttttttttgtttttttttttgagacggagtctcgctctgccgcccaggatggagtgcagtggtgccatctcggctcactgcaagctccgcctcccgggttcacgccattctcctgcctcagcctcccgagtagctgggactacaggcgcccgctaccacacccggctaattttttgtatttttagtagagagcgggtttcaccacgttggccaggatggtctcgatctcttgacctcccaaagtgctgggattacaggcgtgagccaccgcgcccggcctaaagagagttttatgaagagaatatttataaatataatatggacaggatcaaaacaacccaaccaaggactgagaggcgctcagaatctggaatcagcagagaagttgtattgcctctaggactggattgttgtataagtctgttcaggttgccataacaacctggacaggaccgtagttctgtccagtgatcctccccaagacaaccgttctctctagtaactatggttttcctttctcatttcaattgccacctcaattgactgaaatgtgaacaccaactcccgcacttaaacgttgaagccctaacacctactgtgatgatttatgcagctggggcctttgagaggtaatcaggattaaaagaggttatgagagtggtgtcctcatgctgagattaatgccattacaagaagacagacactagaaagcttgcttgtccgccttccccctggtgcacgaagaaatggtcacatgggcacacagtgaatctacagccacttacaggccataggaagagaccttagaaagaaatccgctttgctaccacctttatcttggacttcccaacttccagaagtgtgagaaatacatttctatagtttaagccacttggtgtatggtatcttgttatggcaacctgaacagacttatacaacaattaagttgcctttccactgatggacttagacacaatctctttcccaaaaaagagctatatttagctacttttcttttgcatattgttccatttgcagccacactatttgtcttcccccacaccacttctatcaccaggaatccattttccttgttttctttttaatatcgggagcctctgctcactgcactgcatagtccttggggctttttttaaactttatttttaacaatcatttgagcagaaagtagccaattcagttctttaatttcccattttattcttggtttgaaactgacctgattgtgtcccttttgttatgaccagttacttagaagccatacagcccacaaggtgcccttgggtataaatccaacttcttcattttaatggtgagaaaccaaaagcccacgtttcctgatttctggcccagcactggaactgttttcatggcacgtcaattcatcatacattttaatagtgatattttatatttgcataattttattgcctttgcaatgggctttcacatctatcttctcatgtgtatatagtttagaggccatttttacccactatttcctaatcatatcgaccacagcctcaggaaatgtctgctctattatttcacttgcctgtctgggttcttgggcaacagcatagaatcctgcactgtgttttccctcacgctttctcactctttgcagaacaaatttttgttacatgccttattatcatggtaatattggccttcagtcctgtatagaagcattaaaaatgtgcgtaatgtatatccttttaaaatgttatcctaagaagcatcttttggagttaaggagagttagatgaataaagaaagaatacagtttctcctaaacaaacccactaagaaaatcatggaaagaattatgacaactatgaaaatgaaggaggtatactttgtcaacaaaagcaaaataaccaagctactcttagacataatctcacgttgtctttctgtagtgctctagcattttctaagcattttcacacactgttatctctttttttctttctccttctagaaattaattatgacttttcctttcaaaaatgaaggacttttttttttttttactcttttcattttttcctgagaccatatgtcaaagggaatgtgagtaacaactttggtgtggtaatagccaaattcctccaggtctgctcctcaagcttgcaaagtcaagactggcagaagtggtgatttttacctgggtatcctgagaaccttgcacagtccttatcacatgcaggtgttcagagtgtgcaaataaacgaagaaatgtgagattgtgatgatattttcatggcatgctttttttccacacttcctcatgcagcccaacatcctctacaatgtgttgttctacccgtttaagtgatttaccacttctccattaagccaacttaaaccatgttgccttcaactcaacattgattgatcccctatacagtcctgtagggaggcaagaaaacttacaaacgaagtggtaaagaaagagagagattaagcaatttgccccaaatctcataaccactaggtgataaatcttcaactagaactcaaatatctgactgagaattcagtgcttttttcatttaaatcacattgcttcataaaaatagatctgcaggaagaataaaaatgtccaaagtgcaatgagacagagaagataatatggagacagacatattgcacagaaagcatttgaccatatgtctgcctgatctccttcatgtgtcttgttcataacttactttactcgggcagcaggagatagcataacaactgtcagagtgaatttaggccacagttttgtgttgctgaatgtgttgagtcatttcccttagttcacatttctacctaactttatcttttaagtcatcatcatggctttaatctcttatttattttgactgttgagattttgtagccattatccaaataaaacatttattttcactcgtgagtccctaatccttcgtcaatggaattagctatttatttgatgcaatagctagaccagtagggttaaaaatgcttttataaagacattaatagctgggtatggtgatgtgcacctagggaggctatggcaggaagatcacttgagtccatgagtttgaggccaatgccttcgcaacatagtgagaccctgtctttaaagtaaaaatttaaaaattaaaagaaaagacatttaaaaaggctgtttaccaaaatgatggttaattgacagaaaatagaaacggaaactagaaatcattgccatcagctttctctaatgtgtacttgatccttttctccctgtgatggaagtcgaaagtctttttgtttttttcttaatccactactgttcaaatgagaataaacagccaaatgactgaattagttggtagacataattcctagtcttcaattatttttatattcttttgtaatacagtcattattttttcagacttctataatattgcatttaaccaatccccaaatagggaaacgttatgtaatttttctattatttacagttccttgattataatcttttatttgaaaagattatatatttatataaaaacccagtttctttcttacatataaatattattagtagtctaaaaatgtcactctcaataaacaggatgagtcaacttgaggactagagaatcaggtagtcaacatcagagaactggtttagcaaacagaaggggcctacccagatagagagaagtcaggcagggctgtgctgtgaaaatattagagaagcttgatgggaggcctaatatagtttgtctttacacctgtatattttgcttcttgcatctgcttcaatgccctctgtcatttattataactagatatattgttctaatagatttgtactacagtcagagcaaacaaatcactggatccagcagaagccttagatatatgacataacagagatttgcacaaagatttgccccattgccttctcaaatttctcttatcatcaatccatctagctggagctctctgaaggtcatcagaggtcagtataattttaataagattttaactgaaggctagccttgatgttcagtgaccttcagacatgtttataatcgagaagccactccccctgttgaatgataacctcttccatgaattaccaaaccaatggtgctcacattctgattaacgattgattcccataaacccagcttcccccaacactgatgatctaaataacctgaattatttgcattgccttatcaattccatctcatttcctgtcttggtggttttgctcacactgcttctatgtggaatgtccgtatgtagccactcgagtttccacttcatcgttccatcatctgtagtctctatacactatccatcatcaggactaatgtgagctgactttcctccaaaaagctttccctgaacttatcctgaaataacgtttttctctgctaacttagcatttgtcacgttagtatacagcttctctaactgtcatgaaatgaaataaatgggaagaagatgaaacatgaaaagaaatctgcttcttaaggcaggccctgggggaatagccctggctggaggtaatgtaaggtctagatggtgtttttagaatctgaagactgcaacaccaaacacaacaagtataagcctaggcaagctgtcagtgcagggcctaaaattaggtatttcaacaagtggatgaatcaatttggggaattgtattagtaaacagaggaagcccgtccagtaaaagggagagtaagcagggatgcaatttaaaactattgaggaaaaatggctaagaaatagtaaaattaacacatggcctaaaatattaagaaattatgcctgttacagaattacggacctggctagtatataggagcattaacaacacaaaaacagattaggtcgggattagcagtgggggtgaaataatcttcagggctgaactactgagctagaaatatttaaatcctccttgcagatgaaaactatagaggacaatttattggttcagcatgaatttctggtcttctgttaagaaatacgctctttcattgaaagtgaacattgaggcagtaaactccaaatacagctgcaggtactatctcctgctgatttgtgtgtatagagcatgaaagaaaggctcagaaacaaaagcatgttggaaaaataagcagaaggagacatttacttgcaaagaaatgtgaggaagtcattcttcaaaagaactgcccaaaaaattaaaaaaatagaactttttaagacaaacaatattatgaagacaatagggcttatattaatctcttcatggcagaaaactgcaattttatcatggttattgtattcagaaagttcatgacatatcttcagacaataaacagcattgtaaagtcaaggataaagtgattttcattaaggagttagcaactctcaggaaatgctcaaggttttattcatttggaggactgcaggtagacagagagacccttttattgtttctttatgtcagagtgcagagtttttttttctctgtttcttcagcagtgggacatgatgaacgggccgacaatggtgtcaggccccgatgtcactttggtttttacacttcatcttgcggtcatgtttccttctctacaggacatgtttgtctacctccatttgctgaacaatgttcctaatcagtactattgattttacattttaatttgatccattttatttgcacagatctaagaagtgttgattaatatttaatgacctcctagtatttttttgatgaaacaataaactaaggctcacaagtttacgtctatctatagatttataaagcccttgtgctttaaatttacttttacatgtttaacagctcagtttagagcagaccaaaccagtccgttcacctctacctgatttcatctgcagtatttataatgcaaatgtatcctttttaataaaagttatccaatgtctcggtgtccctgctctgccaagaaaggacattctttcttacctccaagcctgagattgcatagtccatagagcaagcaccagattggtttcctagaaggatgttataggcatcgcttctgcatgaaaaacatagaaattattcttattactggatttgtcttgtctaattaaattgaatttgtagcacagctataaattttttattaaaaaattgattcttcctggctgggcaaggtggctgatgcctgtaatcccagcattttgaaaggctgaggccggcagatcacctgaggtcaggagtttaagaccagccaggccaacatggtgaaaccccgtctctataaaaacacaaatagtagcctagcatgatggtgggtgcctgtaatcccagctacctgggaggctgaggtgggagaagtgtttgagcccaagattgagaggttgcagtgagttgagatcacgccattgcactccagcctgggcaacagagcaagactccatctcaaaaaaaaaaaaaaaaaaaaaaatttctaatcagtaatatattcaggtagaagggaggacaaattcttattgaaccaatacaaataactacatagtcacataaagtaaatgtttttattaaagaaactttgtgcaagatttaagcaatattgctaattaagtgtatgttaatagacaaaaccaaatattgtatgtcacaattctttacaaaataattatttgtatgtttttcttggcaacttattagctttgtttttatattaagaatttctgcaaggtatttttttcctcaacactaagaattcagagtgttttatttagtttttacaaatttaataatttgtacatttaattggagattaaaggtagattaagaagaaagaaaatgggtttctctcatgttcattaaagtagaaaattaaactagcctcaattaaattgccttactgaggccctttaatcctaaataacaacctcttgtcgtgctggtcttgagttaagcagtctactttcatgaattcatcggcttctacactgtgagtgtcttggaactcctgactcatttacttcgtatagttggaatattgtctgtggggacaaggtcagcctattcttggaggcctatatccatgagtcaatttcctgtggtatcaatagtatcaacagtgtctgctaccgttattactggagctcttttgatacttcttccagatgactcaaattctgattggcgctttgtagagaggcttttaggtatgcttaaagggaaaggagggctgggcacagtggctcatgtctgtaatcccaacactttaggaggctgaggcaggcagatcacttgaggtccggagtttgagaccagcctggccaacatggtgaaaccctgtgtctactgaaaatagaaaaattagccatgcatggtggcgggcacctgaatatagctactcgggaggctgaggtaggaggacagcttgaacctgagaggtagagtttgcagtgagctgaggtcataccactgcactccagcctgggcaacagagcgagattccatctaaaaaaaaaaaaaaaaagcagcggggatagggggaggagatgttgctaataataaaactgtaaagtttggttaattttttgccatagcaaacaacatcacaatgggggacagtggcattctctgttgaggtgtaatacatactcatctaatgaaattttaatcagtgattaccgtaaaagacagaacacatgaagaacaattagtgcatcccgatacctctccagggcctttaattttccccacaaagtagatattattatttgtcaccaactgataagtttactttttttaatcagttggttgacatttattgcaccagtctttgtacatgaacataaatatgcctgaatccaacctgagaagtgcacaattattataacatagccacagtaatcatacataattattgcatttaattaatttaagatgattttattgctattttctcagaatatggccttgaaaaacacagcagcttccactatattgagcatagttttgagcaaattaaacatctggagaatgcaaaacattacctttatttctaatatatcttcatgttaagagctaggaggaggatctctggagtttcccagcagccatctgagaaacccagagatactgtattcataagtaacatctcagtagttttactattttggatttgagggttaaatttggggaatatggtatcaaaaacagtgtcacaggtgggggctgcagatgtgaagggcctgctatcaatcaggtgaccctggatggactacccactccctgtgtcagtccaggatcccagctgtagtgggttcctctctgctacagcacatgtttctaaagggcaagaatctgggctcccaataactgacctctgtctcctccatcctggcttgtcatggtagacccgaaccaccctcccattgaatttgggcccttgtggctcatagccacaagggaaattgggagctcacatgtgaaaggcagaattaagttaatgcaccttcttccaaagtcttacgtttgtttgtagcccaggtgcccctgtttccagcaggagtattagcagtaccaggcagccactccccagagtttgtgtttctgagctttcccatcatcagttaattggaaatttcaggaactgtccctgccttacaatgcctgctctgatctacaggtcttttggagacagacagcaggtgatggggcatgccaaagagataaaaatgtcttctgataatcaggggtcagcagatgagtatgaaagctaattatccccactactcagggaatttagaggcttccccttttgtctttgtaggaatagcagactttctgactgtaatgtccaaagttctttacaagttgaagtacagaagagatcagaaaatgtcttacgcacatgagagttgttatccaaagatttgtcataggagcagcgactctaggtgttctctattctatttagaagaattacattagattttgattcctcaatgtggccaagaaatagagctacttgctgggaacaagaaagacaacatgacttctggaaactatttattatgaaaaatgaattttcattatgtagcaaattacactgcagaagtattacaaagaattctcatagacatggtatattaaatctcaaatcaataatcatacatagtcaattaaaaatatctttgttgatatctttcagaacctgggaaataattttctgactttcaaattttttagtttctattcagtggcagaaaatctgtattgtgccaaaccagtctgaaaattagtagttgattatatgctggacacagaaaaattttctataacctgttaaatgcaacactccattcattgcttaattctccccaaatagcataaggtaattaaggcttttgtaaacttttttctttttttagaacagcctacagtgacagaggagaatggttatattgttaattaaagctggttcatcactcatgtggtaaacctgactcacatggaaacttaactattttatcacaaagataaatgtttatcatttaaatatgtatgtattcacttttatacttcttgaaaggatttctaggagtacaaagtaaactactataaatctcttttctcccggatggcaatattgttgtgggtgagaaacaatttagtccaggagagctatatctaatccggtaggacactgtggagaatacaagtgttaaatttttgctaaaaaactaatatatggccgggagtggtggctcacgcctgtaatcccaacacttcgggaggccgaggagggtggatcacctgaggtcaggggttcgagaccagcctggccaacatggtgaaatcccatttctactaaaaatacaaaaattagccaggcatggtggcaggcacctgtaatcccagctactcaggaggctgaggcaggagaatcactggaacccaggaggcagaggctgcagtgagccaagatggcgccattgccctccagcctgagggacaagagcaagactttgtctcaaaaaaaaaaaaaaggttaatatatggagattgatttatcattttatcaaaaaggtaacccaaatactaatatgacttttttgagaccatccatttaacaaattggactaaaagactcaaaagttcttttatgttttatgcccaaactaattaacattgagtaaagttagtccaaaaattataaacgttttattgctcatttaaactcattatttgcagctattataagctatagcaaatgaagtttacttccctcagatattctacaattattgtatgcccttaaatttgtattttaaaattcagttttatattctagcaaaactctacaatttgccttttagacaaaattactctctttgccttgataagcaaaaacacattaattatattgcatgcacttttctaaatactcaaactgacttaatttcttaaagtagtataaaagaacatgtgcattaatcagaactaagggtacttttacatactgttcattctcctacttgatagccactctataatgtgtaaaaatatgcagcaaggatatgttaaaaattttatgagactcatccaaagatttttcactaattatctcaatgaaatattagccaagctcataaagctaactagtatgttaaaattcattttaaactgacacactgcagagaatttatactaaaatataaaaatttacatgaaaattgtgttacatatgaaatttgaattttttaccatgtagggtatgtgtggttttacctatacagtataattatttgtagccccatctcaagttacaggaacaaatgttttaaaaaatactagtttaataattcaattcagctgagccataaatccagtaggggacatctagaaagctctggtaagttaaaatattttataaaccagaaaaatatgctaacattaattctaagattgtgataaaatcagagaaaaaacataattaatttaaaccaaaattatcaaaccatatacatttatccaaggatttcccatgattaaaaatattactgaactttacttcagtcaaatttttaaaacgcttcaattttgttctgaagcactgaagtcctttgcgttatgcgattctcttacccgcctgccttcccttgcttctcgccttctgacatagcaacaaagtccattaattcacctcagaactaaacctctctatagattttttcttctgagctgcagttcagcaagttacctgtgctagtatacataagccaaggaaaacagaagctccattaaacttaagaaattgtttaacctaattcattaattttctccagagataggaaaatgtacaataatttgttcagaagatatttacatacatacaacaagaagtcattatcaaattcggagccagtgatgattttctccctgctttattgtagactttcatatgctatttatttatagtccttatccagtcagattatagattatggtagagacgtaatttttgaggttgagtaatactttactgttgatgtatagaatattcctcacaacttattttaactcatttttatatttctatgagattttccttgtttggggttttttgtttgtttgagaaaagggctagagaaatttaaatgcttgaaaacctttagagttttcagaagcacccagaacttcaaagaaacacaaagctattctcattaatgctttcttaagacaaataaagcaaagccctatcaacagttagagctctccatttttcaagctatgcaagattgtctccaatagttatggcttcagcagtggttcagcttgagtgtgcatcagaaccacctgcaaagcctaattaaacggattccttggctcacttggcagtatatgactcagtaggtaagatttgagaatttgcatatctaacaagttgtcgggtaatactgataccgatgtctagggactatgagaatcactaacctagagtgtttaaaaaatgaccaatttctgtgcccaattatctgccaaagtttcctaagagaaggaaaacaacaacaacaaacaaacaaacaaaccaaaacagagagaaactgagagaaacagccacaactggaaactagtaacacaaaaacaaaccattgtaaaggctaattaacttattttcataccaatggggaaagatttttatttcattttgcacccacaaaaagctttaggagttttttcatgtgccagaaggaagcacataacctccaaattcacaatctattctttgcccgtttgctgtagttactctttgtaccaaaggttctgagtctggagtctctgcttccactggtcagatagactctctccttacattgtggtctctcactgaatgttctcacccactgcttcctcactacgtaatatctgcccaagaagctcccgtcttctcattctcccatcccatatgctgacattctttccagtccctgcattgttatgagagctcagtgggtgagggagctgaatgtctgtattcagtccacaactacgatctaggatactctgtattaaccataaataattgatgcaagtttcttccactcagccatagctgagccagattacccgcaatgctatctcatcccaccacagtctctacgactaatttctattatacaaggtaagatcaacatttgaagtgattgagtttaaacataaaaagatgtattggctcctgcgactgggcagtcttcagggttagttgcttgagtgatcaacgataccattaagattatgattgggacatgaaaaaaagaactggcaaataaggagagaactttgacaatagaaaggcatttaatccttgtgttgttttgagcgccctaaaggaaaagacaaattaaaggcagatcctaacagaactattaacaaagaaggaagagggtgaatgagactcttgaatcaaaaattcttaattcttaactccacctgtgaaatcttacttaatctggttatactgagaataatcatcacaccattctgtctcacattctagaaggctttgtagtggtagaactgtaaacaacatataaacatttctgaaatattgtggttgttttatcttccataaacctcacacaagccgtgtgtatgatcatccatcttctgggccattatctgattattgctgctatctctcgctttggggaaaggaggtctctttccttatcaatactattggatcagctcttctaatttcatgatgacatgagtgttcaggaatgatggaaggcaaatgtaactctgagaaaacttggtttaactactgcatttcacaagtccatatccatcctagaaggtcttccagcctgctctctgccttgctcccaagatggccacatgtaggtctcttctttcccgtaaccagagggttatagattatattatccttcaaagtctgggataaaccaatttctcactctaaagagaacaacgtgttttgatttttccaaccctaaccctagcctaaagtctaccttctaatcctatcttattacaaatgtccctggattgatctttcaagggatttttgcctactgaaaaaatattactctcactcaaagaattgtggcctgacaagaaatctacaagagtcttggacacagaggccaaaacatcataacatctggattattcaggataaagtaatatcacctgtgggttacccacagcccagtcctcagcttcagacaatgccggagtcactagtgttctgttttctttcctctatcattcctattcaaaaattctaaaaatttggagttccatttctcttaagaagacatgaatacattagtacagtaacatatttatttctacttccttgaaattttattgagaaatccatcattttccaaacttttctttctattggtgtaaaacagggatgaatggccatgagcacttcattgcctcatctcaggtgacacttctttgccctttgaaaagcctataatgtactttataatgtagtttaacttttccacttcacctcatgtaaacaaactgattttccaacttatcaatacagtatgaacatttctccaagtcaattaacaaaaagaggaaatatcactttaaatgaatgcacagtttctctatatagagaaaaataatatgtgtgcatatatgcatgtgtaaatatatgtatatgactaaattctacaagtttttaaactatctttttactgatggagactcatcatggtttttttccccctgtactacaaacaaagtagccataaacattctaacattctggagtatggtatcccttatatgaaatgcttgggaccaaaaatattgtagattttggattttttcaaattttgaaatattttcatatcataacatgatatgttaggaatgagacccaatctaaatttatttacattccctacatatagtatacatgtagcctgaaggtaattttatgtatttgtaaaattttgtgcaagaaacaaaattttgactgtcttttggctgtgaccagtcatataatgtcatatgtgaaatttttcacctgtggcatcatatcagtgctcaaaatgtttccaattttgaagcatttcagatttcagattttttagttgaccttggaacaacatgggtttcaactgtgcaggtccgcctacactggtatttttttaaaaaaaaaatatatcagaaaaagttttggagaattgcaattgaaaaaactagcagactaactgcatagcctagaatataaaaaaaaaaaattaagaaaaagctatgtacatcctgaatgcataaagtatatgtatatattaatctattttatcatttactaccataaaatatacacaaatctattataaaaagttaaaacttatcaaaatgtatgcacacaaaccgtacaagtcactatttgcagtcaagagaaacataaacaaacataaagatgctgtattaaaccacaactgcatacaattaacaatagcacatactgtactacccaaataattacttttattttatttttataaatgtgctaggtacaagcatacttttattatatgattgttttgttatttggatatattgctagtggtgaagtctgagcttttactgtactcatcaccccaatagtgaacattgtacccaataataatttttcaaccctcactcccctccaaccctggcatcttttggaatattctccagcgtctactttccagtgtatgtactattataataattttgtagccaccccctgttgctactgtggtgagctcatgttgccagtatctgccatgagcacttggtctcttcagtaaattctgtatctacgtaaatagtgtgttctctcacagttctcttttcattgtgcttagtgtaatactataaatcttgaataacaccatgagaccaatacaaagtgccacaagtgatgctgggagtgctcccaagaagcagagaaaagttgtgacattatgagaaaaagttagattgcttcctatagattgagttcttcagctgcctgccatttcaaaataaatgaatccagtgtaagatcccttaaaaaaaaaaagagaaattcataaggcctcattttgtgccaacaggcatgaaaaccttgtcctttcttatctcatattcaaaatgcagcttttatgtggggtacagaattgctataagaaagacatacctatagactcttatttgattcaagaaatagcgaagtcattatttgacaacttaaagtaaaagcaaggtgaaagatctaaagctggagaatttaatggcagcaaaggatgatttgataattttagaaagtggtttggttttaaaaatgtcaggataatgggagtagcaacttctgccaaccaagaaccagcaagtgaattctcaaatgccgttaagaaaaacattgaggagaaaggatatctgcctgaataggtattaatgcagctgaaagtgccctattccagggggaaaaataaaagccacaaaggtcatttattagtaaggaagagaagcaagcaccaagatttaaggcaggaagggataggctaactctactgctttgtgcaaatgtagtcgggtttatgatcagggctgcccttaactataaagctgctaacccctgagtcttgaaagggaaaagagaaacactagttgccagtcttttggttgtacaacaagaaggcctggactatgagaatgctttttctggattagttccatcagtgctttgtccctgaagtcagaagtaccttgccagtaagggactgctttttaaagttttttgttgttgttgtttaattggaaaatgccccctggccacccagaaccccatgagttcaacaccaaaggcactgaagtgttctccttttcccccaaacacatctctacctcagcctctagataagggagtcataaggacctttaaggctctacatatggcactctatggaaaggtttgtcaacattgcaaaagagaaacccaatagagagaacatcatggaagtctggaaggcttacacctttcaagatgtcatcagttgatatagaaaaccatgaaactcaaaacaataaattcctgctggacaaaagtacaatttgtgtccagatgttgtgcatagctacagaattacgacaaacccaatttagagaaaaccatggaaagaagtatggatatgaagggaaaaaaaggtgtggagtgaagggttgcaagatatggatcttggaggaatttaagagctaatacacaccacaccagaggaattaacaaaagatgacttcatggagatgagtgcttcctaaccagtgccagataatgaggaagaagacataggaacagcagtgccagaaaacaaattggcattcaacaatctggcaaaagaactttgattattcaagactacttttgacttcttttatgacatagaccgttccatgatacaggaactgaaactgaagcaaatggtggaagacggataggtactacactgaaatgtttttagagaaatgaaaaagcaaaatagacagaaataatgatgtatttttgtaaagtttcaccaagtgtgcttgcctcttttgcttccccttccatcccttcaccctcttccacctctgctaccctaagacacaaagaccagctcctcctcctcctcctctgcctactcaacatgaacacaacaatgatgaagacctttaggatgatccacctccacttaatgaatgggtcatatattttctcttccttacaattttcttgactataatttcttttctgtagcttagtttattgtaagaatacagtatataatacacatagcatgcaaaatatgtcttaaatgtaacgcatgttatcagtaagccttctggtcaacaataggttattagtagtttggggggaatcaaaatttgtatgcagatttttcactgtgtgggaggccagctcccctaaccctatattgttcaaggggcaacaatattctttctcactggcactttactttccataaattcaaatcccaaaagtagaactgcaagttcaaaaggatttttaaaaaaataattactgtcagattacagaaagtttccaatttacattttcactaccaatgtacaatgttggcatccctgaatccttatcagcaatgaatttttaaatatactataagagatgaaaaaatttttttaaaatttggaattccctgatcactaatgaagttaagcatcaatattattcctttaatatgcaaatgctgaaaatacatttaactataatagatgtcaaaaatctgtaaatcaggctaggtgtggtaggcactcacctgtattcccagccactgggagacttgagtccaggagttccagactgtagtatgcaatgatcaagcctgtgaatagccactgcactccagcatggacaacatagcaagaccccatctttttttaaagaaaagagtctataagacaaaggtcctcataaattaagagaagccaagacagtcactgtgactgcagaatattttaatttttttttattatactttaagttctagggtacatgtgaacaacgtgcaggtttgttacatatgtatacatgtgccatgttggtgtgctgcacccattaactcatcttttacattaggtatatctcttaatgctatccctcccccagccccccaccacagagcaggccccagtgtgtgatgttccctttcctgtatccatgtgttctcattgttcaattcccacctgtgagtgagaacatgcggtgtttggttttttgtccttgtgatagtttgctgagaatgatggtttccagcttcatccatgtccctacaaaggacatgaactcatccttttttatggctgcatagtattccatggtgtatatgtgccacattttcttaatccagtctatcactgatggacatttgggttggttccaagtctttgctattgtgaatagtgccgcaataaacatacgtgtgcgtgtgtctttatagcagcatgatttataatcctttgggtatatacccagtaatgggatggctatgtcaaatggtatttctagttctagatccttgaggaatcaccacactgtcttccacaatgatttaaccagtttacagtcccaccaacagtgtgaaagtgttcctatttctccacatcctctccagcacctgttgtttcctgactttttaatgatcgccattctaactggtgtgagatggtatctcattgtggttttgatttgcatttctctgacggccagtgatgattgatgatgagcattttttcatgtgtctgttggctgcataaatgtcttcttttgagaagtgtctgttcatatacttcacccacttgttgttggggttgtttgttttttcttgtaaatttgtttgagttcattgtagattctggatattagccctttgtcagatgagtagattgcaaaaatgttctcccattctgtaggctgcctgttcatgctgatggcagtttcttttgctgtgtaggagctctttagtttaattagatcccatttgtcaattttggcttttattgccattgctttcagtgttttagacatgaagtccttgccatgcctgtgtcctgaatggtattgcctaggttttcttctagggtttttatggttttaggtctaacatgtaagtctttaatccatcttgaattaatttttgtataaggtgtaaggaagggacccagtttcagctttctacatatggctagccagttttcccagcaccatttattaaacagggaatcctttccccatttcttgcttttgtcaggtttgtcaaagatcagatggttgtagatgtgtggtgttatttctgagggctctgttctgttccattggtctatatctctgttttggtacaagtaccatgctgttttggttattgtagcctcatagtctagtttgaagtcaggtagcgtgatgcctccagctttgttctttttgcttaggattgacttggcaatgcgggctcttttttgtttccgtatgaactttaaagtagtttttttccaattctgtaaagaaagtcattggtagcttgatggggatggcattgaatctataaattaccttgggcagtatggccattttcacgatattgattcttcctatccatgagcatggaatgttcttccatttgtttgtgtcctcttttatttccttgagcagtggtttgtagttctccttgaataggtccttcacatcccttgtaagttgggttcctaggtattatttcaaatattattgtaaaacaatgagatattgaaacatacattggagcaaactcttcttcatttttaaatcctttcagcacagagacaatcaactgactgtctgggtactacctgaccactattggagtctctttcatctgcctgagtctgtgcaacaatatgaaaattaattttactatgcacgtaaacgttcctcaatatattgaattcttacagaatttgaagagtcaaattttgtaaatccagttacctttttccactactctaggcctcatatactatctggcctaagggttaaaggtccacaattgaataagccaaacttgttaatttgagggtaaagcatgtcaagaaatctggccttaatgtccaatgaacttatgtcatattaagtagctggatagaaacatgcattccaaagtggatactgtttatcaggctcagtgctctattcttgacggtaaatcccagaatagggtggatgctttaattttgtattaaatagtattaggtgtaatatcaaaaccactaagggaacactaatgatgagaataggaacactagctgtggagctggcaattttctatagaaatcctatctctttcaattgcctgtttagtgggcaagtgtttcagttcctataatatctaaattggagaaaatcaccccacctacttcttcaggtgttatgataattatgagggataacatctttttaagtgtttaacacaattcctcacacatagaaagcaataataaacattggctagcattgtaaggatggattattgtcttccaatgtgttttcatacattttctttctgggatcttgagtgaaacatgtggatttagaacaagaacaaaatgatgttaccttgatgatctctatgtagggtcacactcaaggcatcttaaaatattttgctggccaacaaaagacacctcctgttctaattgggcattgaccttttctttaaactatgcagacaaacaatattataaagtgagaacatctgcataaaaaacctaaacataaatcttaatagtgagttcatgaaaattcttactgatgaaatggcaatgtcacagactgactgtttatgtccccccaaatttgtatattgaaatcctaacccccaagctactcgtgttaggagacagagccttggggaagtgattaggtcatgaggacaagattctcatgaatgggatttgtgcccttataaaagagatcccagagagctcattggccccttccaaagtatggggatacagcaggaagttgccatctatgagccagaagggtgaacctcaccccagatgctgaatctgccttgatattggacttcccagcctgcacaactgtaagaaatttctgttgtttataagttactcagcttgtggtattttgttacagcagcctacacagactaagacaagtagcattttgaggattaaaatttcttcataaatgaatagagtatgccctgttaaaccatattctcagctaaccccgtttactcactgttcctctttattttagtttcacatttttgctatttatctctgtaattttattcattcttcacaatttgccattcttatacttcgaatcatgttatcagtttataatacctccatcaaatgatagtctgcatttgtttatccttggctgattcaaaacacttggcataatttccttaaaggaaatcatcttcatcccacctcacaacactgtattattttcaattaatttccaataaactcttaattgtccatgctctgtcagagttggcagagttaatccctgtttaagctaataggttcaacttcttcaacaaacaaatctttcatgaaagctgctgacaagccagagtattaattaaatctagtttcattgcttctcactttccttgatccttctctcttgttctttgggaaacagtcacagagttctggcgctaataaatactataaaaagtaggaaatacagtctaaagaagcagaatattctgtttaaagttgatgtggtgctttttgtgcaccaagcattggctcaaaagcctgaaaattaggcagcaatacttcctaagctcatcttcaaccataaggcagaaaagccaaacatatctgaaaatataatatcactggtaccttataccagcactaagaataagaaaaccctggaaagtggctcgagtacagtatttttctattggaattaatttttcaaaatggaaaggacttcattgttatttttattataaaattagtatatgtttattattaaaaataagtacaaaaatctctaaaagaaaaagggaaaaattaccagcagttccacattccagatatcatcactgttagcatttaggatacaaatatccaaacactttttctatcaatacatttaatttttaaatttgaccattacgcaatgtacacatgcactaaagcaccacactgtaccccataaacatgtgcaattattatgtcaattaaaaacaaaataaaagcattttacaaaaaatcatgttatttttaataacttgtttttctaattttatacaccataaaataaatgtctttacatgacatttattttatgataataactaatttattcatttaaacagcaaggtacatttcattctacagatatactatataatatttactccgatctctggatgagaatttatgttgcctgtaaatattgtatcacaaacattataagaataatctctctaaaggttttcttcctgaattattatttgggtagaaaaattactagaaatagaataactgggtcaaagattaaagacaatttaaatttcaatatatagaatcaaattattctccaaaatattgtactctacagtatttgaattttgatttttttctccattttcactactgccaataactttaatctttgtcgataaatgagacaaaaaagacaaataatgcaatattatacaagggagattaataggtagaaaaagaaatgcaatggccaggagtaacagaagatgttcaacatcaatccaatcaaattaatgcgtctttaaaatgcaatagcagtcaatgttagcaagagtgtaggtattagacattctcataggaatataaactaaggccatgttttaggatcatattagatcgcagcaattaaaaaatgttaaattcatatgttgtatagcaacttctcaggttggaatttatcacatggagaatcttgtaaaatacataaaccaagatatgttattaatgttattggtagcctattgttttaataaaaaatatatttatacaatacagttgttaaaagttaagaatatcttgaaggtaaattattaaacaaaaatagaaagcctaggccaggcaagacttcatctcatgcttataatcccaacacttttggagactgaggcgggaggattgcttgagcccaggagtttgagaccaacctgggcaacacagtgagacctcatctctagaaaaaaaaaatacaaagcctagttctgaacatccttttgtgtaatactaaaagataaaattttattttctatcttgtttaagatctatattctatacgggggttgtgtattaaggtcatttttaaaaagatactcaagaaattgtcaacagtgattatcttaaggagagattctagatgtctgggggtaagagactagaggaaagagaattttatatttcatttttacctttatttaattttttgattttcttactgggtgcatgaattatatttttatgtcagcatgttttatcagataaataaaattatgagctatttctgttttctctcatttgttttatgtttaaataaaggaaaatgagatatgtctttttaaattagataatcttgagtccatgattattatgaaagccctctgttatctttttccttcctttcacaatgactatttatgttgtagaatcattaatttctcaagacaaatgtcttagaaggtagatacaaaaaaatggtatacattttttgattcaagctaatttcatgttacgaacaaaattacgtaatgtcatttctaagacctttctgtgatctatcaatccactaggttaaagagcagaaatcacttccaaaacaaatccttttgcagtcagcaaaatgaagcaattatatgaataagtttttccacttggcctatttttctacccatggttattaatcagtctcactgactacattttccgttttacatcccctttcaggcactactgcagatggccaagcatatcacattatgtaaataaaataaaacaaaatcttttcccattgagcaaatggatatacttcacctctaatgcttccagtctttctcagatcattcaaaaagcatgatatggtttccatgaaaggacattcatcccatttgactaactggaatttctttactccagctaatctttaccaaagagctgaattaattcaagttgacaccctgttatctaccagctcttccagcccttttgcttgattgttttgtcattttgccttttcttttcttctaaagtgggagtatggagatttacccttctgaaacagctgtgtcacatcatgatccttgagaatatcagctcttaactggctgcacatcaaaatcactgtttcctttgaccaatactctagacacactcaagcagagattctggattctgatttaattgacacagagtagggcctgggcatttttacagctccccacatgattctattgtgcctcatctatcctagcccttaagcaggaccaaacatttgttctatcttaattattattctcttaaacttagtccaattccttacaactgatagctttctatatactcatctgccttgagtgatgacaattgatatggtttggctgtgtccacacccaatctcatcttgtagctcccataattcccacatgttgtgggaggggcccagtgggagataactgaatcatgaggatgggtctttcctgtgctgttcttgggttagtgagtaagtctcatgagatctgatcatttttaaaatgggagtttccctgcacaagctgtctctttgcctgctgccatccatgtaagatgtgacttgctcctctttgtcctccaccatgattgtgaggcctccccacccatgtggaactgtaagtccattaaacctctttcttttgtaaattgcccggtctcaggtatgtctttatcagcagcatgaaaacagatgaatacaacaatactgtaacaaatcgactcacatctgttctctttataggaattgcagtgctacaatattagtggctcttaattctaagagtgttaaaaaatattaatgcttctctcacccctaaagtctagggtgtgacctgagtattaggttatttaaaacttttctcaggtaatagacatgtgcagccaaggttgagaaccactctatagggccaagatatgtaagaaaattcaagtcctttagctgggcgtggtggcacacagctgtagccccaggtactctggaagctgaggtgggaggattgcttgagcccaggacagagaggctgcattaagctatgatcacatcactgcactctagcctgggtgacaaagtgagatcatgtcaaaaaaaaaaagaaaaagaaaggagaaagaaaggaagaagaggaaggaaggaaggaaggaaggaaggaaaagaagaaagaaagaagaaagaaaggaacaaagaaagaaagaaagaagagaaaaagagagagaggaagaaagaaagagagaaagaaagaaaagaaaaaggaaggaaagaaaggaagaaagaaagaaaaagagagaaagaagaaagaagaaaaggaaagaaagaaagagagagagaaagaaggaaaagaacgaaaattcaagtcctgccttgtaaaatgcagtactccattttcccaaagagatcccaagggaaacttaactacaggataaagacagacaaaaggacataaattacaactactctaggttcacatattattttgtttctgaaatgggttttaaaatatctatgtcagagttcatttctagaactttatctctagaaaacatattttcacttctcaatacaggaaaatggagattggaaaaatgagtttggaaaatgatttccatgcttatctctcagcttcttttttcaacttccctttttcatctccgtatcttcactgatacctaggaatctctgttacatcacagtcttcaagagctttgctcacagcgaattagttaagacattagctttcaaaagtatatgatattctctcacaagcatttgtctacttttaatagggcaagctacgtaaagatgttaaatctcattccagaaataccacatctattctacctatttatgagaacagtcgtctctagaccaagatagaaattcatagttaggaaataaatccctgtagggtttttccacagtcccaatatgtcccctactgtcccgattttagcaacaaaaatcccccatccagaaaatccttcattcctgagtaagttgaaagattggtcaccctatttctatctgtgtctctttctttcataattggctcataatcatagcagtcacaattttgaaaaatgttattttactgaattactcattgctgttttctcattttttaaataataaacacttattaagaaacattggaaatataccaaaaatagtaaacaataaaacagaaaccattggcagaaatagtcactattaaaatcttaatatactcccttccaatgttgtttctgttaatgcaaattaaaaaatcagagattcgcctctgtgaactagatctctttttacctttagatattatttgacaaatacatagctcaatcatctatccaaacttctcttttacagactccatgccaattaaccttctcctatgaaactattatttcttcacataggataaatatggttattgacacacaaactttcttagttacactgcaatccagttgtgcgttcctaaatttataccaattggatttagaatgatcattactaaagaggcttggccttatctcttgcaatttgcttcttccttcttaaattcaattcttgtaatgtaactataatttgggggtatctttttgcctcatattcaaattctctttcaaactgaggtacatttctgtatttctgtatttgtatattgcatataatagtatagaaaacaataatgagattatagtgtacataaaagttttgaagtataattaaatatttaatatataaatatattaaatatgggctgctgactcaccaagcctggtttggcttccatcacttgtgtaatcaatcacctgtattaaatcacctctgcttgaaagatgaagaatagtttctgatttataagcaaacactgaaagctcttctatttcttgtttgctaaacaagatttgtcaaagttaaatattttattttattgaattcactttttgcctctcctacaatgatgatttgcttttcctcctttaacttgttaatgtgatgaattatacatagtttttttttctattgttagaaatccttgcattcatggaacaaacacaattttcatactatattttttatagacttctaaacttaatttgctaacttttaatttaaaatgtttgccgttaggttcatgaggaaagttggcatgtaattttcctgtcttacgcatttctcatataacattggtatcaaggttgtactggcctcataaaatgaacgaacaaatggacctttttttattctggagttgtttttataaaatggaaataatccatttcttgaaaacatttgatagaactcaccagtaaaaatgtctgggcctgctggttctcttcttctaagaagaatttggaacttataattaaagctcctttaatgtgttagaaaactttccaggtttccttgaacattaataaattccaatgacgaaaagccctcagatattaaatataaccttaaatataaccttcccccaattcaatttttcttttgcagatatgattagatactctaatttttcaacctctatttcacatatccattttcctttcctcctctgtactgtcttcagcataatttgtttagtctaacttccaactcacttattttctttttggttctatccaatattgtgtttaacctgtccatttagtttttaattttcattatattttttatttctaaaagatctcttaaattcagtttcaatctgcttaatataagatacatacactgtctcaatttatattcctggcacacctcattgattttttaaacatattaaacacagcttttatagttatataatcgtcctaatatctgaaatctttatgggcataattctgtttctgctcatgatgtttatttcctcatgagttttgtaagagtcttacttttttctcattttggatgaaattttacctgtggccattctttgagacatgggctgaatgtgggtttctccaaagacactttgccttcgtcttgtgtttggtggtaataccaacatgggataactataaaataaattatcagtttcatgtgtgggttttttttaacttatacttacagtgaaaatttaaaccacaaattcatgtgaagatggccttctcatttttcctctaaatagcaccgagtttgaggcaggaaaatttcctggttgtctccccctgaggaacaggtttttatctagtttatcctttcactgaaattatagtccttcgtatctctggctttcagcagttttctcctgtaagactgctatactgggcaggcactaggttttgtctcacactctcccatatcccaggtggtcataaaaattgaagctcagggtactagggccaggactgtccttatggaagcttctggtttgggggtctgcatacctctctggatttatgtattctccttatgcttggcctatgtggttcaccttagtttctattcaagtcagtaatatacttttgaaaaatgacatgtacattttatctggtatttgtagatttcatatagcaggatagtgattcagcaaatttagtctaccacaatgctgggaatagaattcccctaatttttgaaaacattatattaaatcatgtttattgccattaatagtcttataaatgtgcttttaactaactgcattttgtcatagctcattgtgattgtatatttaactagttcacccctacctcatgttttttgggagtgaaggttgtactcaactcattatgttaagtaatactacagtaaacatcaatctatacatgcattaataatgatttccaagaaagtagtgacacatggtcataatcatctttgaggctggtggtacatattttcaaattgcatctcagaaataatataccaatctgtgctctaatcagccgcatatgaaagtgtcatctttctgttctccaaccaatacaactactactgtttttatacctgcaaatctgacaaagatgtgagaaggcatcttatagtttcaatttgtatttctttggtgaccaatgtactaaattactcaatgtactaaattactcttttcctgtttatgatccatttcaaacaaaatgtaaaccattttttaaatttttttatattaatgcaaatcgtaaatcactactttatttattcaacttcctaagcaaaattatatgttgtcccatttatacattttatattagatctttctgccttacatttataacctaaaaactgtcagaactatataataatgatgaacagttgattataaataatgtctttattaggatatttctccataaatctaaatttcatcaatctttctttaaatatctctacacaatgtcctcttgtattatattaataattgcagatacacttctttttgctatttctattctttcctattcctattgtctgttagtctcccattttctcccataaaataaataaaaatttttctatcagattctgtgatatattacttcttattcccagccttcaacattttaagaattcagattgaccttttctcccattcttatttcaagttatcagcatgtcgatacttgggaaatcccatcaagtgtttaacagtgcataccttactgattcattatttatttcaatttaatctttcttattttcattcaacttttttctcagtaatacaactttttcaagctttttattttctaatgcatttctccaaatagcagccataacccttatatgccctctttcaatgacaacaacaaaagtgtgctaggcttcttggaagaaaataatgataccaattcaagaaggagaaaattgatgtactgataaacaaatgggcatcttaggatcatgtttctcacaagtaaggcagttccagaaattcctaggaccataatgggttttattctaaataggttaaacatatcacttaaaaaattgttttctacagttctctaatattgcttacaattgtccacgtttccatgtttataaacttgcacttttttttttttttatggagttttgctgttgttgcccaggctggagcccaggctggagtgtagtggcgtgatcttggctcactgcaacctccacctcccaggttcaagcaattcttctgcctcagccttctgagtagctgggattacaggtgcgtgccaccacacctggctaattttttgtagttttagtagagacggggtttcaccatgttggccaggctggtctcgaactcctgacctcaggtgatccacccgccttggcctcccaaagtgctgggattacaggcatgagccactgctcccggccttatacttgcacactttttaattctaagaccttgctactcagtgagggatcctgggactaataccatcagcttgacttgaggccctctttgaaagcagactcagaatctgtaatttatcaggatccccaggtaatttgtatgtgcagtctagtttggtagatctgctctggcagactggaagactcctctatctgcctcatgtaaggtgcaggtgacataattaggtaatcaagcaaaagatcacatattttaataagaaagagacactggctattattttgagtggcaaaacaggttattcagtcccagtttaaaatggaaatgacagagaccaagatgaagatttttaatttgagatgtgcctgcgatgcaattacatttgctgaatgaaactgcttcagtaattagatgcaggtttcttctctcttctttttgagatgtaaagaagacacaatagactcatggaacttaaagaactagacgccagctaacaaaacatgctatccaggctctttcgtttcaccatattgctttcttgaaaacataggacagtgccagtttagcactgaaaaaaatcagttctcctaattctaaaaagaggagacagccaggcgtggtgggtcactaaaaatacaaaaaattagctgggcatggtggtgcatgcctgtaatcccagctacttgggaggctgaggcaaaagaatcacttaaacccgggaggtgaaggttgcagtgtgctgagatagcgccattgcactctcgcctgggcaacaagagcgaaactccgtctcaagaaaaaaaaaaaaaaagagagagagagagagaaactgtaatttcatttcagaagttttatagggtactatttccaattctttttttcttactccattaaagtgtaattagcagtatgtgaaaatttccactttatcctcaatcagaagcctctccttccaattagcatatattttttctattaactttgtaaagtgggattcttgttttatacatacccctggaaagtatacttaaactgtgagaccctgggattttatatttccaaatagaagataccatcctcttgtatcacaaaatgtacctaagatggtttggattatatttaaatattcttgaatgaaatagacttactgactgaagccaattattatatttttccacaccaaaataaatgcaataggaaaagatgacagttctatgtagtattcctgcttccatattgcacaaattagaaacatacatattccattatgttacagggtctagggctttgggaggacaaggctgcaggcagccgagattgtgccgctgcactccagcctgggcgacagagtgagatcttttctcaataataataataaaagtaaaaagaaatataatatttaatcaatatatgcacacacatgggtttatcatgacacacacgacatgtgtgtacagtgaaaaaaatgagtaaatctagaaacctgtattgcctcaatagctagctaagtacttcaatatgcatgtttatttcaacaattttgtgttaagcttcagtggtaaataagcagagtacactgaccataatgaatacttcttttgatgagggttatcactacacaattaaaatattacatagttggctgggcacgttggctcacacctataatcccagcactttgggaggccgaggcaggcagatcacctgaggatgggagttcaataccagcctgactaacatggagaaaccccttctctattaaaaatacaaaattaaccaggcgtggtggcacatgcctgtaatcccagctactcaggacgctgaggcaggagaatcacttgaacctgggaggcagaggttgtggtgagccgagatagcgccattgcactccagcctgggcaacaaaagcaaaactccgtctcaaaaaaatatataataataaatatatatatattatatataatcaatataatataatatataataaatatataatatgtattatacaaataataaatatatatattatatataataaatatatcatatagatgatatagtttagagttaaatactgactgctcttgggaactttgaggtattctgagggatataaataacacgaagagaatagcacattggcttgaagcagattagagtctgctacctgcgtgaatacttgtttttcatgaactatgaggatgcccttagcttttgaaccacttctacttgtgttgaaatttaccctttaattttggggtttgacaggctctgcccttctgttatgcttgagtctggcttttcctactctgactcactttgattcttgacctctgaatcttattcctattttacaataaacacacatcgcacatacgccaattagtagagtggaagagggaaaaattgccaaggaactatgtttaattttgttcctttcgcaaaccagacaccataacagaaaaattttaggaacatgtgcatgttcagtagccttcaatgcaattatactggttattaaaaagtgttggataatcaatattttttaaagattcactagtcccttctgataattttagaactttgggaagtaataatacaaatgtatttttagctgtgtcctttaatcttttactgtttcctctatgtgtggtgtttggtttgtgtgtgtgtgataattattataaagatcagaggctaacagaggtgttaatcacgaacttttaaattttttttatttttatttttttagtttttttaagagacagagtctcgcagtgttgccaaggctggatgcagtcacgccaactcagctcactgcaaccttcgccttcagggttcaagcgattctgctgcctcagcctcccaagtagctgggactgcagaagggcaccacgatgccccactaatttttgtatttttagtagagatgtggtttcaccatattggccaggctggtcttgaactcctgatctcatgatccgcccacctcagcttccctaagtgctgggattacaggcgtgagccaccgcgtctggctgcatgaccttttaacttgtctcatacactcaatattctcaagatataccttccaaagtgcaaaattatggcactttgcagccctgaccactaactgagaactttgatgctttggattttggagacctcattttatcacctggtccttttacttcatgacttgtcatgctgccaccttttgatgggattgagatgaagataataattcccaactggtcaggaatattgtgcccctttgtttttatatccagatgcaatagagcctctgacacaccactactattgttcttaggatttggaacaaaatgcatctttctttgacaaaataaatgttttctttaaagaactcttgattgatcctggaccattgtagaaactgaagtcctatcaatgcaaaaaaatatgacaacatgagctgcttatcatgaaataagtgttttccaattaactatcctgcttcatcagcaggtaggaataatagaatctatacctatgtcttcatgggaagttctctatggccagttgattagtgagggaaaaattgagcctgatttacagaagtcactgtacaacatcacagcagcagccaaaagtagattgcttaggcattataacctacgtgaatgcaattttaaaagaaattcagcctatgtaattggttgtccacgatgtctagaaggagagatattattgatgtatatgtggcagctaataatttgtctagataattagggacttggggccaggcctgatggctcacacctgtaatcccagaacttttggaggacaggacaggtggattgtctgaggtcaggagttcgaaaccagcctggctgacatggtgaaactccgtctctactaaaaatacaaaaattagccagatgtggtggtgtgtgcctgcaatcctagctacttgggaggctgaggcaggagaatctcttgaatccaggaggaagaagttgcagtgaaccaagattgcaccactgcactccagcctgggcaacaaagtgaaactctgtctcaaaaaaaaaaaaaaaaaagaaaagaaaagataattagggactcggaaagacaaagactgaaggattggtggcaatgagttttggggaaaaaatatgtagatgaaccacagaaaatgagccagagtgtaagaatatttgtgcttaatacgaatgctcacgaaactatcatcaggaaggttatcaaatagatatgaaggtatgaaacaatctctttcaccaggcactacattgcttgcttagaaggctaataaacagcaacattggtggtagcagtagagaatacacataggtttagcaacatgttggactttaccactctcgcttacaaaagcctatttagctgtcaagactattaggtgtccaacacacaagcaacaaagtccaaggctaagcacacaataacatatcctgggtgaataaaccagtcaccttttgtcagacttgttgattttattggagctcctctatgataaaggcaacaaggaattttgtaaatggaatctacctttaaccttgaattacatttgctttacctgacatcatttttctctgatcgccactctccacgggtacattgaatgccttatatatactgccataatatcctgttctacatccttctcttaaaagaacttgttgtataacaaatgagtagatattcattggactcacctggtccaccatttatcctatcactaaccaaaattattattattacagaatggtgaatattttattaaagactcaatcacagtgtcagctggagacaatggcttataaggttgtactcatgctagaggatgtggtggtgtatcctctgaactagtaactaagtataagcttgtctggtgtctcctatataaaaaatacaacaatctttgatatttgttatgaatgttgaagtgactccttttgtcattacatctaatgatccactccaaatacttgtctcttgtctctgagattctaggtttttgcagaattagtaaccaaagggagagtcttagcagtattccattttacaatccatccttcgttagaggatgagagacttctatctagccttttaggttgcctgagacctttaaacaaacagtcaaaaatttaaaatttaaaatgcggctacactgtggcatggggtagtaaatcttgaccttaaaactggtatttgtaagaaaaacagaaagaattcagggatcccctttgatggctcctaattctatacagtcctgtaaatattcctgaagactaaccaggcatggtggtgcacacctgtaatcccagctactccagaggctgaggaagagaatcacttgaacctgggaggcggaggttgcaatgagctgagattgtgccacttcactccagcctgggtgacagagcaagactctgtctcaaaaaaaacaaaaaaaagaagaagaaagaaagaaagaaagaaagaaagaaagaaagaaagaaagaaagaaagaaagaaagaaagaaatgaagactgccacaacttggaagcaaccaagatgtccttcaataggtgactgcataagcaaactgtggtatattcctacagtggaatattattcagtgctaaaaggaaaaaactatcaagccacaaaaagatacagaaaaacaaagacattttgctaagtgaaagaagccagtctgaaaagggtacatactgtgatttcaactatacaacactctggaaaaggccaaactataaagacagtgaaaagatcagtggttatctttgcagacgccaccatcgctgtgagccctgtactatcagccatggtcaactccgtcgtcttttttgaaatcaccagggatggcaagcccttgggccgcatctccatcaaactgtttgcagacaagattccaaagacagcagaaaactttcgtgctctgagcactggagagaaaggatttcgttataagggttcctgctttcacagaattattccagggtttatgtgtcagggtggtgacttcacacgccctaatggcaccggtgacaagtccatctatggggagaaatttgatgatgagaacctcatccgaaagcatacaggttctggcatcttgtccatggcaaatgctggacccaacacaaatggttcccagtttttcatctgtgctgccaagactgagtggttggatggcaagcatgtggcgtttggcaaggtgaaagaacgtgtgaatattgtggaagccacggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatctttgtgctcttgctgcagttccctttgggttccatgttttccttgttcccttccatgcctagctggatggcagagttgagttaagtttatgattatgaaataaaaactaagtaacaacaacaacaacaaaaaagctcagtggttgccaggagtttggggatgggtagggagataaacagttctgaaacaggcgatttttaggggattgaaaatacgttggtaataatgtaatgatgggtacatgacattatgcgttttgcaaaactcctagacctgtaccacacaaagagtgaactctaatgtaaactgggggtgggataaaggtgacagtatgtgagaactctgtactttctgctcgatctttccataaagctaaaactgctcaaaaaataaagtctattattttgttaaatgaaagaaattaacaatgaccatggcacgctcacacaaaaagattatcaaggacatttctctgtcaggaatgaatatttggtcatttcacaaggcaaaaccctgactagcagaggtgttagctgagggcacatggccatagatgccaatagtgacctgctggccacttgcagaaaggagagcctttacatccaaacacattgtttctcttgtattgtcctgtgcatacttatgtatcttaacaactttccttctttcctctccatttatccctctttttaaaacagggcttattgagggtgattaacttaatttttaaatgatatatggcagaatgtcaagagagtatagtgaagaactttgtagaggaatggacataacccagaattcttagacttagagtacatgctgtgattgagaattttttattgtttcattgttcaagagattgtaggtacatgttcaattattagagaaatagttgcactctgttagaaggaagcttgggtctttcgtgtttactttcaaaagggaaagtttatattgatattgagcaagttaaagcatgaatatttactatttgatgtttgttcctgtgtttgaggaattcctcagcctctcagttttgacgaaaacaagaaaccacctcctgctttagaagctaaaatgtcaaatgcttgctttctcagcctcctttgcagctatctgttgcaaagcgaacaagtgggagtggtgctggtggctttgcagttagcctaggattgagcaattgctgcaattgttgctctctgcatcttcggtgttacttcttactggtggtgacagtggtttcctccctggatgagttctacagcatggtttggggtacatttcctggctgcctagctttgatctggctctctagccttctcaacagttctacaagttccccactatttctgtgataaacctatttattgttaatgtcagccataattggcttctgtggtttatattttttaaaattccaagatataccaatgtaacagatagctcaacaaacatatgtctttttaaattaagatatattctgtgtcacatgaagtacaatggacaaaatgcaacaaattgaattgagctaaagaccaaatatatattaagcctggctggtcttaaaaatgtaactggatacagccaggcatggtggctcacgcctataatcccagcactttgggatcctgaggtgggcagatcacctgaagtcaggagtttgagaccagcctggccagcatggtgaaaccccatctctactaaaaatgcaaaaattagctgggtgtggtggtatgcccctgtaatcccagctactcgggaggttgaggcaggagaatcacttgaacctgggaggcagaggttgcagtgagcccagatcatgccaatgcactccagctttggcaacagagtgagactttgtttcaaaataaaaaaataaaaataaaaaaataaaaatgtaactggatagacctaaggatcttgaataagcagaaaataatttaggtaaaaaccaaataataaactaacattctgaaaggtttaggatttggaggcccaaatgtcttagctaaaagtgttcattctaacctcacaggaaaattgaaatatgaaaatatacagaaaaatcttaggcagtatttatcaattttaagaaacaactatttacaggtttttcaataggcattacattaaaaacaaaatatatacttaataaatatgaaaactgtggatataatcaacacatttattttacttcttgaagtgttaacatgtgctgtctcaaatatcaacagtgtacacgtgagaaaaaacattttacatagattttctgcgacagaaaacagcatctcattagacatcccaagtttttttcatttggaacacacactcattccccagtatactaggggtaataataatttaaagagtttaattactttttactactagaaaactaattttatgtttggcacaaatttctgaaatgatattccactgcaaagaataatacctatatatggccagaattacttttcttctataacattaagataatacttgtcagcctgagcaacaaagtgagacctcatctttacaaaaaataaataaattagacgggtgttgtggtgatgagggtctgtagtcccagatactcaagaggctgaggtgggaggatctcttgagcctaggaggtcgcggttgcagtgaactatgattgcaccactgcactccagcctgggtaacagagcaagatcctctctcaaaataaaaataataaaaaaaaagataatattggtataattcagggtttttgcctcaatccccatgcttcttcatttgaccttccctgactccctgatgaattttagtttgaatttttgctatagtccagaagttaatttaaaagatcttaaaatttccacctgcctagatattacttatttgttacactttagtccatgatttctattgtcatttacattaccccaaaaatatgacctgctgaatttctgctgtcatgaattgactaacatattttgtgcctaaaacctttacatttagaatctttttgtttcgtattggaaaatattgtaagtcctccatttattggtcaaaagcactgcctatttatttccatgcttaatcagagagactttccaatagttatttaatattatttacgttcattcacttgttgactataatgaggttagttgctatgatatctttaggtcattaatataataaaaatatgtcaacttttctcttccaatgtgtctttgggttattaatttttaactcaggtatcaagcttgtaaaatgtttaatggcttataataatgtctaacacatagtatccactgagttctgataactctggtttatcaaattctctttttttgtaccattctccaaatgcaatgctatttggttttatttttattttttaaaaatgtgctgcctgttttgagtctctaaaagtgtgaaatgctcagcatttcccaaatgtatttgaacatggagtgttatatttactaaaaagttaacaagcaagtattcccctaaacactctagcaaatactactagtacagacaaattatgatgtaacattatagtacattttaacttattaggttaattttggttgcaaacaatcaaaattcaaaatggcttgtataataaagagattttgaacaatagtataggctcaagatagcctaatgcagaagtttaataatgacacaaaataaatgcttcttgtcctccctgtttcttcactctaccttaagtgatatagattgaatgtttgtatcccccccaaaatttgtatgtttaaatctaatccctagtgtgatgatatttggcagtgggtcttcggggggtgattaggtcatgaggacagagccctcatgaatgggattagtgcccttataaaagagaccttagagaacttccttgccccttccaccatgtgaggacacagcaaaaagacagctgtctgtgaaccaggaaacaaatcctcattagaccctgaatctgttgacaccttgatcttggacttcctggcctctagaactgtaagaaataaatttatgttgttcataaaccatccaggctgtgatattctggtatagcgacctgaaaggactaacacattaggtctcagttttattctatggcttaaaatatcatgtcatgagtagacaacttccaatcctagtacctcctgcttcctctgctgcatttggaaagaaggcatttccctcttcaatcatggaatgaaaaagttgtacttcattctgatttgattagcagaaggcacacgttccttccatgcaccaattacaatgaccaagaattgggcatgggactcatgtcacttaaacattgtgaagctgagaaattcattatttggttaggagtgtgtgagagcagggaacactgaatgcttgagacaccaccacgatgtccactacatgtatttccatttcagtaaacatttccattaagataatgctagaacaaaatcagaggagtagatcttggtgtccccaacttttgttgacctaacaaagtgaagttgcttcaactggacacttctgaaccacatttatgcctatatgttcagttcaaatttattataagcaattttcaggtccatatgtttaggatatttcatttgtttggttatgcattatatgtatacatgtttttaacatacatacacctctacatatattttggaggcctttacacaaaagtgttttccctgaagggagaagagaaaagttgaatgcagaagtagaaaaaaaaattcatttgcacttgtagtatttatatctaaatattttatattacagatgtattaaaatttttataattttaaacactactttaaaacagggagatggtttaccttcaaaaaatttggctctcaactcaaagttatcaaagtatatcctagatgtagtttgcttgtcaggcttctacatgaaaatctaaaatgctcctgcatttcagaatgagcctaacatatgtaattgcactcatccactatgtctacattgccaaccaaatactgacagagagagctagagtgccacagagagctggcagttcctctgtttgcattagcttctacttgcttcttcatctttcctctatgtctgacacatttcatgttactgtttttaaatgttcccttagctacagagctaatgtgcttatatctgtaaggggtctcatgtgaacctctaaataattaaagattcattagctccctggagggccaccatgatttccaaaacaagtcacaatacctaaagatctaattgtacaatttccctcagaaatagccttgagaaagaagtcacatcactcagcaatgagtattataattactcacagcagttttcatggtactatataacatccaatttacagaattaaaggtaatgtaattcaaaagaaaaatagctggttttaaggaatgaagggccatgtcaactattggaagcatctttgaactggagcctctatgttcgggtttcaccaggtttatgtttttaattaatatcctattcagcttgctgtaatttccattgaggttttctagaacaagacaagtcagaaattgatctttaattataagctaagagcaaactgccaaagaactgagagaaattttgaagaaacaggtctatcaggactaaccattttaagataataaagactaatcagacacacacacatatgcacaaaaagagggagagagagaacaaaaatcctatgaaatacattttaaaaacttaatttttttaagaagaagcatttgatctgccaaagagaagagttagcagtttggagatctgacattgctaatctcagggcaagaaaataacaaaataagacaccaaagaattacctaaactgtggaagatgaagctttcagagttctcacagagaaatgggatactaaagtaccaagtttaagaggtgtaatctattaatgtttaatttatgtcccaaatacttaaaaactatgtttcattgttatacatatttattttattataaagataatgaatgcagtagggttagatttaaataattcattgggtttaaaatgagaaatgaaagtctggctttttacaacctacagtcttatcaccaaagttagctattgttaataacttcttgtccattcttgtatgtgttatggtttctttcttagaaagaagtatgctatactagtatacatactatttattcatgaaccttgcacttatcatgtaatcatatgtcttagtggtcttttcataatagatgtctctctttcccacgctgtcagtggtgattgcatgaggcattgtacagacgtaccaataattacttactctgtgtcatattgttggttattcagattgttttcactttgcccttgcagacaacactgcaatgaacatccttatgcatatattattccaaatacatcatcgtcatggctgtgtgagagaaatatacattgttgattttatttttttattttttataatttcaacttttgattttagatacagtgggtacatgtgcaggtttgttacatgggtatgttgtgtaatgctgaggtttgcggcatgattgatccgatcactcaggtactaggcatagtagttgtttttcaacctttaccccctccctccttctaccctcgagtagtccccagtttctattgttcccatctttgtgtccacgtgtactcaatgtttagctcctgcttataagtgagaatatgtggtatttggttttctattcctgtgttaattcgcttagcataatggcatcgagttgcatccatgttgctgtaaaggacatgattttattattttttatggctgcaaagtattccatgacatatatgtaccatattttctttatccaatccacagttgatgggcacctaggttgattccatgtcttagcgattgtgaattacactgctgattttaatagaaaccactaatttttatgccaaaaaaatcatcaatgtgcacatgctccaaggctgtgtgagcatagcccttttccttgggatgtcaacaacactgggttttatcaaaatataatttttgccaatttattagttaacaaatgctaactcagtgctatttggatttgaactaccactggtgctgagcaactttttacatagtcactggcaatttatttatctttctctgttgtttatctttttctgtgtaataattttccctatcttctactcttttaaacattaagttttcactgttttcttaataatttttaagtttaaaaagtgaccttttggctgggcgcagtggctcacgcctgtaatcccaacactttgggaggccaaggcgggtggatcacaaggtcaggagatcaagaccatcctgcccaacatggtgaaaccccgtctctgctaaaaatacaaaaattggctggggtggtggcacgtgcctgtaatcccagctactcgggaggctgaggcagaagaatcacttgaaccagggagttggaggttgtaatgagccaagatcacgccactgtgctccagcctggcgacagagcgagactccgtctcaaaagaaaaagtgaccattttatctgctacatataattctaatgatatttctcaattcgtttatcttttaacaatggtaatatataatgtcttgctatttagaaagatttttaaaagtattttacataaagaaatttttattctttgccattaatatttgcaggtttggaattttcaggacctcctcaaaggccacctacaggaaatgctcttcaaagacatttcactttttccccacttgattgtggagcaaagactaacactggcaatgctttgaagtacttgagtcaaatgggtctctcatgtggtcattactatactcactctcaggctccaatgcaaattgtttccttacgccaactactcttgctttcctttaatagacctattcctcctgggctgtctgaaactaacatttaattgtaaataaagtcctgcaaatccttggtatctcaaagaaccctccttccatttagttttaggagaactctccttctaaaactctattcttctccctggagtccagatccccattccttgcaacaaatgaacgcttgatttgagcactgaagggagataattggaagtttgactttgtgttctaggttttccctgccaatatatgcagcgtctttaaaactaattgggctgaggcaggagaactgcttgaacccaggaggaggaggttgcagtgagccgaaattgcaccattgaactccagcctgggtgatagagcaaggctccatctcaaaaaaaaaaaaaaaaaaaaaaaaagaaacagcaaaaagaaactaattaggttcaagaagttcgaatgaattcaacttagacaagctcttaagcagacatgttggaagttccagaaaagacagtttgggaaaatattttattaaaaaaaaaaaaagactgccctccacttcctcactctttcttcccacttattttcactccactggtgcagtttggtgtcaactctccccactctactgaaactgctgcagccgaggttactagttatttaattaacaaaagcaatagattttgttttttttaattgcattatactctactattttgtgacatttaaactattgacaatgtctttcttgaaaatgtgtcctttttgttttttcaaaacacgactttctccttgatgtcctcctttttctctcattatttcacctttacattctctgctgacacctttcaccttaccaaaccttaattaaatgtgtatgcttcccagtctcccattcttggctctcttcccttccctcttattgatcattattgtattctgtgatctcaccaattctcttggctttaacaataaccagatgactccagaaaactattcaaaattccggacctatggagactttgcacccagatatgtaccaacaactcaacctcagttatctctaatattatctcattaagtgccctctaactacagaatgactcctccttctgggtttcctctgcctgaatggcaccaccattcagtggcccacgacaaatgtggacctcatttggaacttctccctttccctcatgtttcattttctcttggctaaagagttattagattcttcatttttagcttttctctagcctatcttcaattttatagtggacagttatgtataccctatatcccaggagagaagggatatcttcttctatgcccctactatgaactagcatatcctttgagtcctttctttgtatgaagcactggggaaatttaatcaacttcataatcacttataatcctcacagtaattttatgagataagttctatttattatccctatcttaaggatgaggaaactgtggtttaaagagcttaagtaatttgggcaaatcatgaaagaagcagtgaagacagaattcaaatctaggcaacctgaaatctgagcctgagcactttgcctccctaataactatctccctttgagagttgtattacaaagttgacaacatttagcaacccttattcccctccccacccctatctctctccaagaaatctgctgtgaggtagagaatgtgttgattttctctgcagtttttagtgcatagcatagggcttagaaaggagaaaatgatgaaaaatatttattaaaataattgtttttctttgatagttgttataaccatcgaattgtgagtgcttaacaattactataaaggagaatggaaatcacagatcttttcacagaatttttttttttttttttgagacagagtccagcttgtcacccaggctggagtgcagtggtgcgatctcagctcactgcaacctccacctcctgggtttaatcacttgccttggcctcctgagtagctgagattacaggtgtgcaccaccatgcctggctaatttttgtatttttggtagagatggggtttcaccacattggccaggctggtctcaaactcctgacctccagtgatccacccatctcagactcccaaagagctgggattataggcttgaaccaccgtgctgggcctttcttagagaatttatagtttacctggaaatgtaaactatatatatacttaaactgagggatatttacaaaagagctttctacttaacccacaagaagctgtattaataacaaagcaaatcaagcttgttcacaggcaactgaatggaatgaatggttttgattggtgttgccagttatatttctaacaagagaaaattcaatgtgagcctcatttggaaacaagatattacagagaggaaaatttgggattaaggtcagatttggtgcaactatgctagatacagaaaaggcaaactttcagctcaatccccagctaagtacaagttcaatggtgaaggcataagaaaatgagccattataataagtctgaaataagtttatgattccacctcaatatgggcatgcaatatattctaacatttaatccctggaaaaaatgatgacatcacactgaaatcttgactcataagagaacttttttatgctgttccctaagtcagtttatttctacttcattcttgcgttaagggtaggctcaattcttactcattcaaaaacggtatcacctgaagcttttctttaattcttgttttctctgcagtgagaaaattaatcaaggggttaaaatgtatattaaattatatatgtattatatgtaaaagttatataatatagatcagagaagaatatattgcatatgttataggctgaattgtgtcctttccccaaattaatatgctgtaccctgccccctgccatcccagtatatcagaaggtggctatatttggagatagagacttttaagaggtaactaatgtaaaatgaggtcacatgtctgggtcctaatccaatatcactggtgtccttatttgaagaggaaatttaggtacagacatacatgtgcacagaaaaaagtccatgagaagacaagatgagaaaatgactatctaaaagccaaggagagaaatttcagaataaaattaacacatctgatgccttgacctcacacttctagcctccagaaccgtgagaaaataaatttctgttgtttaactcacccagtctgcagtaattgttataacaaccctagcaaagtaatataggaagtatatatatatatatatatacacacatacatatatatatatacacatatttgtgtgtgtgtgtgtgtgtatatatatatatatatatatatatatatatatatgtgatagagtagatagatagagacatatacagtcatccctcagtattagtggggtattgcattcaggagccctgcatataaggaagtctgcacatactcaggtcccacagtcaaccttgcagagctcgcatatgaaaagttggccctccacatatgtgggtttcacgtcccacaaatactatattttcaatctgtatttggctgaaaaaatccacctataagtggactcacacagtttaaaccagtgttattcaaaggtcaactgttgatatatagatatataaatatctcatatgtatagagcaagcgagagaaaaaatctctaatctctcttccttcctgctctttttggattgcaaactcttctctcataagtacaaaaagtaatgttaacaaagtaaagagaattggaaatagtagtgtttttgaccactagtgttttgtaattttggaaaaaaaaattactgaaatgtaactttttatttatattgagatgttttgactcatactccaatcatacagaaataatagataaaatatgaaaaagacttctttttacatacatagctggattaaaatattagaaataattttcttccctcaaaggatcccctatttaataaacggtgctgggaaaactggctagccatatgtagaaagctgaaactggatccctttcttacaccatacacaaaaattaactcaagatggattaaagacttaaatgaaagacctaacaccataaaaaaccctagaagaaaacctaggcaataccattcaagacataggcacgggcaaagacttcacgaccagaacaccaaaagcaatggcaacaaaagctaaaatagacaaatgcgatctaattaaactaaagagcttctgcacagcaaaagaaactctcatcaaagtgaacaggcaatctaaaaaataggagaaaagttttgcaatatacccatctaaccaaggggtaatatccagaatctacaaagaacttcaacaaatttacaagaaaaaagcaaccccatcaaaaagtgggcaaagaatatgaacagacacttctcaaaagaagacatttatgcagccaacagacacataaaaaatgctcatcatctctggtcatcagagaaatgcatatcaaaaccacaatgagataccatcacatgccagttagaatgatgatcattaaaaagtcaggaaacaacagatactggagaggatgtggagaaataggaatgcttttacactgctggtgggagcgtaaattagttcaaccattgtggaaagcagtgtggcgattcctcaaggatctagaactagaaataccatttgacccagcgatcccattactgggtgtatatccaaaggattatacatcatgctactataaagatgtatacatgcacacgtatgttaattgtggtgttattcacaatagcaaagacttggaaccaactcaaatgtccatcaatgatagactggattaaaaaatgtggcacatatgtgccatggaatactatgaagccataaaaaaggataagttcatgtcctttgcaaggacatggatgaagctggaaaccatcattctcagcaaactatcacaaggacagaaaaccaaacaccgcatgttctcactcacagatgggagttgaacaatgagaatgcatggacacagggtggggaacatcacacactggggcctgtcagggggtggggggctgggggacagatagcatcaggagaaatacctaatgtaaatgacaagttgatgggtacagcaaaccaacatggcacatgtatacctatgtaacaaacctgcatgtgatgcacacgtaccctagaacttaagattaaaaaaaaacatttcttccctcatgaggtacaaagccaagcattacactggggccatgatagtccaggttgctgaaagatttagatctaaagactgaaaattgggatatatattgagagagagagagagagagaacaaatggtaacctaaatttaataaaataataatagacaaattagggtaacaggcatatgagtactttttgttctaacaattcttttattttcaaacttatctatgatcttacatttatttcccaataaaaaggattttaagttaaaaaaagaaagtttttctttagtaacattttcacaactagggcctttaagactgaggaaatactccaagctctgagcaaactcagtaagtataaatccatatgtagacataccacagtaaaatgcaagatactaaacactaatacaatattttcaaatcaaccagagacggaaggcagattacctgcaaaggaaggacaattactttatcacagacttctcttcatcaacgagaacagacaatacaggaataacatctcccaagttgtgagggagactaacagatgacatgaaattctacgaccaaataaagcataattcaatgggcagcagttaacagaattaagctgtttccagacatctatggagagatttaactcaaagatgtcactgtaaatttgattgttgagatgtagtaatggatacttggcaaggttattgaattagttaaacgatcttcaaagcttaggtcatgtatcttcattaaacacatggtgctttgcatttactaaagaagggcctccgttttctctccaaataaatcattgcgaccttagcaccccaagtgtaaaaacctcttttatttctattcttgatctctagtccctgcttatgtgtatgcataaatgcatgacaccgtgcttctcttttagttatttatttctagagatcatgtctttgaaaatcattatattcccagcaactatttagagtggtactaagctaacttggtttatggtgtcaaccgcatagcagttatttgattggcccattcctttataaaatattttatgcttagatgatgaactccacataaattcagccaggagaatgttttccttggcaatctctgggagattacaaatgttcctttttttttttttttttttttttttttgagatggagtctcgctctgtctcccaggctggagcctagtggcgcgatctcggctcactgcaagctccacctcctgggttcacgccattctcttgcctcagcctcccgagtagctgggactacaggtgcccgccaccacgcccggctaatttttttgtactttagtagagacagagtttcaccgtgttagccaggatggtctcgatctcctgacctcatgatccacaagtctcggcctcccaaagtgttgggattacaggcgtgagccaccgtgcccggcctacaaatgttaccattaactcctccttctgctaagaaataaaccaaaataaaattattcacaaatataactgttttgatcatgctttcagatgatatgtaaagtagcccacagaaggtaaataatattcaggggaaataaattattacttaagagtgggtgctgagaaaaagaaatgtgtgaagtgtgaggtaggaagtatgtgagaaaagctagggcacagttgtgtcttatatttttgttaaaatctgcctgttaagacttcctgattgggtaatgggaatgatacagtaaaatactcttcctcagagtgtctgacaccactgtgataatttactacataaaagtacaagttacattatataaaaagaatggcctggctcagtggctcacgcctataatcccagcactttgggaggctgaggcaggtggatcatctgagatcaggagttcgggaccagcctggccaaaaggatgaaaccctgtctctactaaaaatacaaaaaattagccaggcatggtggcaggcacctgtaatcccagctactcaaggggcagaggcaggagaatcgcttgaacctgggagatggaggttgcagtgaactgagatcatgccactgcactccagcctgggcaacaagagcggaaactccgtccccccaaaaaaaatgacaccaagaaactgaggtttctagatgagggttacacaatgtggatctaaaagcaacagggaaaggaaaaggatttgggcctagaatgtggggaattttagatgctgcagaaagccttctggtgtctttctagaatggctggattttggttaaggcaaagaagaagtaacttttcatggagaacagtagcatacaggagtgcggatggtttgatcatttaaggcagggatgtgaggtttgatggaatatgttgataacaaagattctttgcttggccaactttagtcaggcttctaaatcttcagctaggctaaactgtgcacttcctcgcaaaatccagcattagcaaagaacactgccaagtttaccaaagaacccctcattctcaatatctgatcaggttcttcattcttcaccattctgcaggtgatgtctgatcaccctggccagtcttcagcaagaattctttcagggcggtttagccagaatctcccttactcctgatgtttcctcttagtgattttccattcactgacccctgcattgctcctgggctataaattcccacttccccatgctgtattcagagttaagcccatctctctccccagctccaagactgtgttgcagtggttcctatatctatggtgatggtcttgaataaagtcttctttactgtgcatttgaagtatcactgaataattttttatttaacaactatggtgttgaaactcaactaggacagattcatcactggatcctgggcctctcactcagaaccctaaatgcatgcctttgaagtctttgttgtcatttctgactgattagggatccgttggtgaatcagattcctgagccattgttccagacaaaagcccgttgatggctaaggacagattttgaatctgaagggatgaatattctctctgaagctggagtagagtcgcaggcttcttttgaaagcaatcctctgggcaggaaggtcttcgtgtgggcttcttgttctgagtggtctattctctgagtccctaggctagaagtctcttctttctggctctctttttctgagtgaggggttattccctgattccctgggctacaaattgttcttcctggctctctataaaaccactctgctctttctcttctctctattggatcctgcttctcccatgggagctctgtcacctgaaacccctcttctcaagtctctgctgactatttccatagctggtagtcacgacgaggagacaactgtgtagggtcaatatctgggccaaccatcctgaggaactgtgaggtttagaactggaaattgtcaagagaatccgaacccagctaccatataagagagttcaacttatgttcaatgtgaatgccatggcaatattaaaaggtaagaattcgatccatacgtacttgaggtaaataggagaaacctagaatttatgtaaacagtgagaagattggatgcgttttccgtctcatattttaatactggcagcatattatatatgtcaaaccatcaggcattcagaaatacatgcttatgaaaattttttgcaccatcagacaaaagacaagggtagaagacatttgtaaccctataaacactagtaaattaaaaacagaaggaccttaatgtcctaacatacctgtgttgtgaaaggctgccctgtgaaataccggatttcttaaacatattttaaaaatcataggcgtcaatattttttagatatccttttaaattttctcgttattttacaatgcctatttatttatttagtggctctgctgattttgatgtatatccaaaactttatattttctttaaaagatgttttatacaactttatgtaaaatgtttctgtatcttcacattctctccctgtccttttgttttgctcttatatggtggtcctgagtcttttctctggcttttcaaacctagtaagactatgacactaaagtaactttgcccgtggtttgataatgccttctaaagcacatcctaagctctcgtgcatacaggggtctcctttgagctctgtgcttttgagatcccatacacctaaattccagtactccaaatcagtactgctcagttttagtgactaagtttaaaaatgtattttaatagcaagttagtttagtgccctcttgcttctttcttgactgcttgtatacatgtatattcctttaaatgaatcttggaatttatttaaaaatattaaattatactaatgaaactgtataatgttgtgaattcataagtgaatttggaaagaatttgtctttatgatgctaaatcctttttatccaagaatcatatgtgtctttatatttattccagtctatatttatatcactgagtaaatacatagaaatgtggataaatacagctgtagttacagatacaaatatagatatagcctgttaaatctatatctatcccatataacatatatacatgttatatgtgtgtgtttatatatatatgtttatgtcattaaagagctcccttaatatttttcttttatttcccataaaatttaggtcgagcttgaattttgcttgtataaacaagtaaaaatttatactagttttaatactgatgtttagacattgtatcttattttagtgctgaatattttcacaattattataaatatcatctaataataataatgtacctgataaaaatatttaaaattttacctttgaattattttattgttgaattaaaattcctttaatatgatagtcaatttctgttttatgctttctctatgcatatgcaaattaatgtatccacttctctgtctctatgtagtaacatatgaaaatcaggcctctcttcttctaatggacatacacatgtttgcatatagaatatcagaccctttatagcatttaaaacctttaaagacatgaatattgccttttaacaaacatattttagcatgtactgagaatcccctatttatttttaatttgggctaatcaatacgattattaatattactggattaccaaatttggaaacacactttcatcccgaaggtggatatttgttttttttttttttttgccaatttcttgtcttactgtttcaaatattgttggatattatttgtattttatttggcattttagtatcaacatttgtaattgaggtactctacatattttttcatcaatatctggtgggtttcatagttactgctatattggatttgtagtagacattgacaaaaattattcctgtatgttttatagctgtatgaaggaaactaatatattttacccctaaatatatttccttgatatatttcaaaatggctattgagaagggctggaaaagcaatgttagctgcaaagctgtcttggggagatttgcatcggtagagaatctgccctgatgcagccaggttttctctgaggtctgcccccttgtctggatctaggaaaggttaactgagaggctaagtctccaaaggtctgaaagaaacattttctttctattctctctgaggactactcccagtgaggttccacctatataataagtccactgttgctagccagggtcgttttctcacataacctttttctttcttttccctgtgatccaagaccccatttttctgtaaacttcatgtggtagataagcttctgcacgcatcgtgtgactgggtcttcgttctaagggttccagtgtacacacattacagaaacctgcatgccttttctactctttatctgcctcctattagtgattttcagggagacttcagaagacaaaagggacattctcctttagcctattctcagaccaattcccccaacatttaactgattcctaatagcttaaaatcactttgaaaaatccatatatttatatccttttcttccctctatgatttctggtcagcttgggttttgtttttcattccatttacttcatcctcgaaaagatctattttacgtctatttattctcatttatggacattgagaaaagaaaataactttcatgtgagaaatgcaagtcctttgaaataatcaggcccagagagatattcaaatgacacagcagttctgtcctgctcctctttgagctgtgtgttcatctaggctgcttgctgttgccacagtagctataaattaaccaataaggccacaccagacactataatccacaccccataatagtgtaacagtgtgtagccagtcactaataaatgttatttccataagccaatgagaatttgtgacaaacctctttgcgtcatcacacttctggacccttttttgcctttaagtaacttcttgttgcaaagctccaaagggagttcacatccaaggatatttgggtctgtttcttccaggcagctgtcctcactgtggctcaagtaaactctttgaattacattttgtgcttcagctccttccacttagattaacaacatggatttgtgtcaccatgtacagcaattaaaatgtttacacttttcccctcgagagcactgatgtgttttcctgagcacttggaatagctacgtagtgtttcctgtctagattatggtttctcaaccttggtgctacttacctttaggaccagaggattctttgttgtgggaggctgccctagcaatgataggtgtttcgtttgacctctaaatttcacacctccaccagtcttgacatccccacgataaccctagacattgacaaatgtctcctggggaaaactctccaccagttgacaggtaaagttctggaaatattggatttgtcaattgagattttatgttatccaaaacaaatatttttctttgttcttaaacatctacttccatctacttatctacttatttttacttttatttgtaacttaattccatcaaggagagagagtgcattttctgttatgctaaatttttgaagaatgtattgatattttatgacctgatatatggatgatatgtagatattacatgtttgtattatcaaatttcagggtgataataaaataaatacttataatatttatattgtcactgtatattagttattttctttcttcactacaggagtttttcaacctataggctatgtttcaattctaggttatccagtagattttgaaatgttatgattaaatatctacttctcaagcattcatctttgcaaatgaaacaatcctaagctcttataatacacatcatataaagggcagactagtcaatgtatggttcagaaataattaagtaatatttataagaaaattaaaaatttatatccttaactcagataacaataatccaaattaaaatttgatttcattacataatttaaaatgacatcagaatgctagtaaaaattatacaaaaaatttatgtaatcttattaagctgtgggactttattagcataaattcaaatacaggaaccaaagtaagattgagacctatagtcaaaggttaaaatgtacacattataggggcatgattaaactaatttaaagcataataacatggagaaatattgcaaaacatacattttactgaattaattgttagtatctaatcattttgtgagaaccaaattaaaaagtagctacacacgcacacacccacacacaagtgcaatactgtcaaataaacgatgttcagctacactagaaatcacacctgtgttttctccacagaaaagattaaaaatcgcaataatttttattgtacatatggaggtaaagatactcaaaatattaccctaaaatacattatttttttgagatggagttttgtttttattgcctaggctagagtgcaatggcacaatcttggctcactgcaacttcagcctcccagggtcaggtaattctcctagctcggcctcccaagtagctgagattacaggcatgcaccaccacactcggctaattttttgtatttagtagagacggcgtttcaccatgttggtcaggctggtctccaactcctgacttcaggtgatctacccacttcagcctcccaaagtgctgggattacaggcatgcgcctggccagctttttgacatatttcacgatggctactcggaagactggagatagcttcttctacaagaatagctgaaaagctgtgtttgttggggagatttgcatttgtagagaaaatctgcattgatatagacaggctttccctgagatactcccttgtctgggtataggaatgattaactgagcctggcacgtttacatttctaaaagccatttcctatctatacttcccaagaggagggctgctccctgtgaggtttcatccatgtaacaagaccacctctgctgccaggctcctctttcttccttgtcgtcacctgtcttccacaaagcctgatttaccaacctacagctctgtgttttctgcaacctcaagacagcataggcgtgttgactaccttgcctttcctggagtttttatataaagagtatatatttgtatatctctttataatatacaaatatttgtatagatatatttatatatattatgtaaactccaagtgcatacttgtgcacatatctgtaaacctttttttcctgttaatttgtacattatcagtttgttttatagactcaaataattaaagcttcaagggaaaaatttaaattttcctatagagaaaagacaaatatataggtgacaaataatatttagagtgtaagacgctttttaaaggtatatttgcaatttgtgtcaaaacattgaaatgtacatttgttattttaacaataaaatttcaattaatttaagccaaatacatagtatatgcagaaaatttagcaatatatctatgtagcaccttactgtgcattattgtaaccagccgtctaatataaagaattaaggtagcagctgctttccaaatagcgcatttttttcacagacctattaaataagacaaataacatttaaactttatttttaaatttgcagaatagcagttttcagcagatggtttattttagcaaattccatcttcacattgtgctatgcttttatgagttccagctgttaacggatactattttactgctgaaactatcctgtgtgatataattgctcattatgtgccttaaaacacaagcaatataattattttcaacttggagcaaattaaaatcttatcagcaatttaaaatctctagagtcatcttcttctggttaattattttaaacttgtatttttctctttatgtttttagtgagttctcttatcaaggagaagatctcaaggtgattattcttttttttctcttccatgcacctcgcaggtgtgttaataatttcatttctcagaaaatattctttcatatctatcttacaagatgagagaccttttaatatcttccattcggatgtgataccagtaatggaacatattccagcttcatgaatatggtgatacaaatagttattcatctaacctctttcagtgccaaatgtttactatactcagtgagttactcagttgactggtaatttcttctgaaatcactaatgagaggatcagaggtctggctgttgtctgtacctcatatgactcccagtgcagacaatggtttctatggagcacagacagttgaaaggattgacttcctgcctagaatagtttctgctgtgcttcttatccttcttgtggagatttcagattacctgaattgcttttctatcttaagaaaaaacgcaacaattctcccacctgagaggaatgtaaactgaagtaagttaacagaaccaatccataaagtttttacattgtttgttgcaaaatgcagcgctggtgtctccatcactaaccttttctatccctcattgctctttctttgactgcaataggatacctctatgcaaatctgtattcccgagactgagtgcccttttggtgagctataagcacactcaatggtaggctgaaatactagtttttatctatggcgaaatggaatcatatcagtgaattttttaaaaaggaaatttaactcttgctatggtttgaatgcttgccccttccaatctcatgttaaaatttgatccccaatgttgcaggtggggctcactgggaggtgtttggtcatgggtttggaccttcatgaatggataaaactctcccttagaaatctaaagctatcctccctcctcggtgccctcaggaatgagtgtaccattccttattcacctatgattaccccacccatcctttttgagatattgactacatgtatgttacactgatgcacattgtctgacctatgagtgagtttctggttttcttattttagtttaccgtttgtcctttagtttgtaatgcttccaatttgttctataaatgttctgatgttagggtaaaatccattacttattctatctcatggaatttttatttcaagtatttatttttcatctatatatgtcacatttttcattttataacttttatttttctcctatatttaattttcatttaagtaccttgacatatatatgtatttatctatatgtatttataaaatatatttactttaaggatcttgaaatttccttcttttctgtcatttataaatgacttatttttatcctgttaatatatattttaattatatatgtcttacagcttctttgcatttcagagtttttttttgggtattttgatgttatgctattgaatatctagattttattggctacctttgaataatgttgtgacaggcagttcagtaacttcaggatgagtatttgtctgttgttttaaatcttctctttaaactttgttgagttagtctagagccatctgtaatttggagctaaatgagcactgtcactagggcatgaacctccagtggtctttactgaatatcctggaggtacagaggggattcccttctctgattagaatttggaatataaagagaaaagagaaaaatagaaagctatgcataaacacgtgcattaaaatgaattttatgtgggctttttcatgaaaatgttcctaaggtattttattttttttattgtggtaaaatgcacataacataaaatgtaatctgttaaccattttaagtgtacagttcagtggtactaaatatagtcataacattgtgcagccgtccctaccatccatctccataattcgtttcatcttgtaaaactgaaactctatacccattaaacaatacttccccatttcctccttcccccagcttctggcaaccatcatcgtaccatctctataatgctaatcaagcatagtggctgtgtttcttgcttcctctagtccgcaggtagcatacaaatgtaataaactacttattcatgtcgcatctatttattttctgccttataccaagcttgtgggattctcttaaatacaacatttttatacttacacctatgcaatacccattagcatcgccttcctaaatcaggggaaattgagcttctgtcaggtggagtaacttcctaagatataaaactcagcattgaagtctgtatacttcaatatcctgccctcttctcatgtgtctttactgccttttatgtatgtgttagatgttcaacaaattctcttttttaaactgaatttaagccgtggagcagtgttttgttgaacaataaatatgatataggacactcttcctccttttcatgtatgatcctgttcatgaaaaagagaaattctttcattgtgctagaagcttaaaataatgaaaatgccactttctacattaaacagaaactgaagggaatcaaggtgaattgcatgagacatagaaaacaagtgggaaagaaatctagtataatttgccctttgtgtacctttattatttagcgtttgagtaaatgattcccccaaatatcttcccatctcaattcatgtctataaagtagacgtttatgtctcaccttgtcaagaagggcaaagtctaacataaacatttcccaaaaatgcttcctgctaaaacgtaagctcagtctggctagaaatgcagctcacttcctaaagattaattggtagctaattttgcatgctgttctctgaacttgagtgtaacctgtccgtcaggcatacagggaatgacgggaaaggtgacaacagaagatgaatgctatgtcactaaccttcaaagatgacctgccttttctttcaaattcttgatatcttaagacttcattaattcatctctcttttcccttggttcaacattttgctataccaaaactcatgtgagacaatgacctaatgtaataaaaatggcatttttctttcatgtagttgcaagctaactggcatttttacaatccacatatttcctttgtcaatttttcattctgtattggaagtaattgatgggtatttctgaagggatgaaggtgtttctgtgttcattgtgatccaaactatttctagacctaggggcctttgtaaacaatttgtgcccactgaccaaggatcactgtggcagaaagcagcaaacttgcataagatgtcactgcttcataggttggctttgaaaactaggggcttactctatactcttatgaataaaagacattgatagatgtagtataagattacaatcatattttccttttgacagtcacattataaatcaagatgtattgcaattaatctcaattagctgatcacaattaaaattaataatgtttattattgctgataaaaatcatgtctctcctgttctcaaatgtgcaagtaattcttgtaattttaatacaaatttgcatattattattaattgatttaatctcattggatttggttcatggatccaatttattaaaatattgataatgggataatgagttgtctccccatttcatgtacactaaaaacaacatttcttacaatggtctgcaagcccatcatcatctgcctcatgttaaccgccaaaattcttttatatcttcacccttgatcttaccagtggtcctggccacctcactgtcctctggacataccaacatgctgctgccttacgatcaagactctagttaattttttggcttggaaagatagccctccatatatccattgatcagctcattcaacttcctcaggtctttactgaaacttcacattctcgatgaggcctattcagtatttcaaactgcatcccagctgcaacattccaaaaccccttactcttctgtgtatttttgaaaggatttattgagatataatttacatagtgtagagtgcacacattaatgtctacaagtcagtggcttttagtatatgtacagataagtggagccaccatcacaatgaattttagagcattttcatcacttcaaaaagaaaccccaccttccctagctgttaacctcctatgcacccatcccctactcaatcctaagcaaccacaaatctgttttctgtctctatagattttcctattctgttttcatctaaatagaatcgtacaataggtggccttttctgcccggcttcgttcagttggcataatgctatcaaggttcatgtacgtattggtactttatttctttttataactgtataacattcaatttcatggatataaccttttgtttatccaatagtatttttattgacatttgagttgtgttcagcctttggctattttaggtactgctgctaaaaatacttgtgtacaatttgtgtttgaacacctctttccaataatctgggtgtatacctaggaataaatttctgggtcatatgacaattctatgtttcatatatttagaagccatcaaattattttccaatgtggccagttctagccatagagtatctaactgtggttttgatttgtagttgcctgaagagtgatgctgttgagtatatttttatgggattattgaccgttcatgtatcttcttgggaaacacatctattcctatcatttatcagttttgagttgggatatttgtgacggagttaaaccaatttttctatattcaagatacatatatatatacagacatatagatacgtgtttttcaaatatcttctcacaattttggagctgccttttgacttgcttggttgtcctctgaaacaccgatgtctttaatttttaagaaattttaaatatctaatttttattctgttgctcatgtttttggggttacagctatttctttgctagatccaaaatcctgaagattttcccatatgctttattctacctcttgcatgtgtgtctttaattcatttgagttaatatttttgtatgctttggggtaagggttctaatttattattttgcaagtggtgatccacgtgtacgttgttgacccagtgtgttcaaagactgtctcttcctcattgaattgcacatggcaccactttaagaatccattgactgtagacacatagttttatatatggactctcaattctcttccatcaatctatatatttttccttcatcaatgttgtgttgtcttgattactgatactttgcagtaaggtttggagcatggggtgtgaattatcctaatatgttttctttcttcaagattattttggctattttgagtcccttacaatttcatgtgtattttagaatcagcttgtcagtttctagacacaagtctgttgggatacttgcagggatttcatcaaatctgtagttcaaattgtaaagtactacaatatcaaatcgtccaattcatgggtgtaaggtgtttactaattatttaaatattctttaaacaataatttttaattttcagagtaaaatcttgtatcacattttccaaattaattaatatttctttttttatgctattttaaattgaagtgttttcttaaattcattttggggttttcattgcagatgtgtgcaattgatttttgtacatttaccttgtctgctgtaatattgctgaaataatttacgagttctatcgttcggtggattccttaaaattttctatatacaacaatgttattttcaaataaagttttatttcttcctgttcaatatgggtgactcttgttattttagttgccgatttgccctgcataaaatctttagtacagtgttgactagaagaggtcaaagtatatatcctattcttatctctgaccatagcgggaaagcatcctttaccattaagttgcctgcttgctgttggcttttcacaggtgccatgtatctggtgtagaaagttctctattcctggttcattgagtttttatttttatttttaatcattaaagcttttggattctgttaaatgtgttttccgaatctatcgagatgatcatgaattctcttttcttattctatggataagatgtattaccttaatggattttgggctgttaaaccaacctgggattacttgtataaatttcactttgtcatagtgtataattcttttatatgttgctagatctgatttgttagtattttttaaggaattttgcatttatacttatagtagttttatttttctatgctatttggactaatttttgtatcaaagtaacactggccccacagaataaattggaaagtgaatatttctcttttttaaaaaagctagtcaagaattaatatcaattattcaacactaacaaatattattattataaattattaatttctctaattttaattttcttccttctgcttgctttaggtttagtttgctattcgttccagtgccttaatgtggaacgtcatcttatctcatcctttcatttgtcttttcattttgtaaatagtgtcttgttagcatcaggtgagctccccaggttggtagtactccatgtttgttgctgtacaacaatgacaggtaatatgtcctgaagacaatggaaacttaaccttcaaaatctcctagattccaccttatatgatatgtctcttctattggtcctaatttctaccctttctctattataaaccatgagtacaatggcattcaatgagttctgtgagtctttctagtaaattcttgaaactgagggtgttcaggggaaacccctgaactggcagttggtgtcagaagtgagaatcttcttacatggcctcttcctttgaactgtgcagctggacgcaaactctgcacaatttgggccagaactctcgtgttgactttgtagcctaaagtatcttgtagtttgtctaaccctcaataaatttgctttcatcaaatattgtatttgttaccccaaaattaccatcacgtttttttttctccaaataactaacataggagaaatagccagctgagtttgtaactcgacagaaataagtgatccatataccatataccatataagtggccatttcattttgccttcttccaccaaatcttagcaacctcaaccattaccaagagccactgtaggcctaccagctacaaacaaacgagtatcttgtaaaaacacttcatactcccatttgataattttcccagcaaagagatgcctactttaactctatgcaagtggctcatattcacgaagtctgtagatattattcatgtagagtgagaaaatcatcccagcggtgccagcacattctccttcctatgatctgcttagtttgcaaacatattcaggccatgggtgagagatttgtatttcacagtacaacaattttatggagggcattgaaacttacattgagcattttagtacagtcacacatcactgaatgatagggatacgttttaacagatgtattcataggcaattttaccattttgcaaacatcacagagagtattacaaacacctagattgtacagcctaccacgtttaggttatatggtatagcctctttctcccaggctacaaatctgtgtactacattactgtactgaatactgcaggcaataagaacacagtggtaagaggttatgtatctaaacataattaaacgtagaaaagtatgtaaaaatatctattataatctcatgggaccacttttgtatatgtaatccatctttgactaaaatgttattatgcatgacatgactctatgacaaaaataaaataacacattgtaaaaaaatatacacaggtatcaaacatattaatattgtaaaaataaaaatatttattcagtgtaagaatttgtaatgatcacaaaatgttcacagcttatattttagtacagtttcaaatgcctagtgcaattgctatttatttctgtgtgtattttaaacatgtatataataaatatttttcaggttcaacaatatatatcaatccaactggctcttataaatattagttaacatcaattggtaaattcatatatatatatacacacacgtgactcagtctgtatgcgtgtatgtgtgtgtaaatgtaactgtatgtgtgtgtaaatgtaactggatgcatcctaatatttacccttacctacaagatttccaagactcatttattctctttaaatggtgtgccttgaaagatttaccaaataaaaccgcaatcgtggaatatatcaagatgttattaaattcatcttgtgcacataattgtttctttaaatttatgtttcttgcaaaacttgcggtaatgctcatgcacaaaataattttctaaataaaaaataaaaacattttctcagtcattaattcttaaaaagtatttctccccagtaattaatgcgaattcattcttaattcttaattatagaataatgttgcccttcagagttctgaatcttttgcacgttgtatacatttcactgactggaacatcttctggaatattggcattaattaatctcactcagcaattaatgatttcaaagaaattaaataccattcatattctgaatcacaagggtactttggcacctaatttaatcaagctctttgtatcatcatctacagtttaattacttaacaaacatttctttgtgtgagaaagattgagcaggttattgtgcttttcgttgtatacatttcactaagtagaacatcttctggaatattggcattaattaatctcactcagcaattaatgatttcaaagaaattaaataccattcatattctgaatcacaagggtactttggcatctaatttaatcaagctctttgtatcatcatctacactttaattacttaacaaacatttctctgtgtgagaaagattgagcaggttattgtgcttttttatgatgcaacttttgcttaatctagagataggcaatgctccctataagggacaaagagaaaaatgaaagagcaatagagatgtgacaggcatggaaaaagacaatacatttataaaacaaatagggccacagatgatgataatggggatcaaatcttgagatactgactcagtttataaccgcactgtacaatagagcaaatcatttgttaattattttacaaatggaatctaatttaactaagatgaatacagtgttttaaacaaggcaggtcatcttaaaataaaatagtgggaaaagtgataaaaccaatgtaaaaatcataaacattttataaagaatttttgtcatgtaatttaatatttttctttatttaaaatcacccaaatcaaaataattttatcttaattaacaaataatcatcagaagttaactaatttttactttataatactaggtttaaaaattcttcactatatttttaatcatacatgcttatacataaaatagacatagggtatatgtttacatgttcacaatattatattgtaattgttcctatggatgtggtttttcaatagaattaataagtacttttaaaaagtttcaatttcaatgatatatatgtttgatttttctttgacaaagcatacatatattgataggtaataataagaaaatcttctaaagacattacaggaacatgaataagtaattaaatcctcaataatttgtaacgttttatgtaagcggaacacatttaactgaaaattgcttttatataatactcaaacgagactaaaaacatattaactagcggagtaagtcttcaaattgataatctgaactatagaagaggagaaacttcaagcactcaaatatttgaaatgctacaaaatatttatataaactattatttaacaatttctgtttgtagagtgctatagagtaatccatataaatgacatctcagtctttctatagctttgaccacatttacctcctaattttaattattaatatgttggagcagtgcatacaactagattccgatcttcctttttaatgagtaaaaatatgtcctttgagacagcattaaagaaagagcaccttgtataaattcaatgccaagagacaagatattcttgatgctgaagtcttgttcttttatacagcaatgtaattaataagaagaagaaaagcaggacatagagatggagtctattttcatcaaaaattgtctatagattttgatgataaaatttaaaactctactatatttagttagtcacaaaaaactaggttgtgggaacatatttggtcaataaaacacccctaccaaatgccgacaagaaaaaaagttaggtaccacctttcttctctgcagatggcctgagatgggttaatttgaaagaatgcttccaaacctgaggtgacccctgagaacagcataatccactgctgtctcccacattcagtttctcagtctgtgctcttttaattttggggggagggaagccagtcctttaaagcgatcttcagcatgatggcagagccaaggagtgtggacaggtggcacggtgtctgattttgttccagcagccacttgggctttctctgggtcttctctgccctcgggatagcactactattgaaaacatgtctttgtgacattctctatgccaggaactcccaacatattttccttgaaactgatgaaatgaaaaaaaataaaccaagaggtgtgctgtttgtttctgtttcctcctttctgcagcccttcttgatcatctaatatttttaaatacattgtcgatcaccaaaaggagcataagggctttattggtttgtagcagatgtattcatagcccagcccctattccttagctgtagctgctgggaagaaaaccattcttaacactctacaaggtctcatctccagaatttgcaccagtttctagctgaggactttctctagcagcacgggagcttgttactgggcatgaagtgggaagaaaaggtgagggtaactaagaagaatctccctggattcagtgatgtaattctgaggcatgctccacatagcttcccataaaattaagcccagatatctaacacaggaacttacctcttaacacgtgtggtattggcttttctgtctttcctgttttattttgttctcttttccttgtctcactttcgctgtgtcctcactcctgctttaagaatacccaaacaaatacgttcatttatttttttagactctcagaacacagttgatagttgaacttgtaatctatgataatcagcttggttgctgtattgacaggaagatggtgaactcacaatgtctaattaagatacaatttaaaaaatatattgtatcatgtccaaagacttaaaaagcctaagcggcagcgtcacagtttcttctttttagtttgcatggtttcttaaatgcctacaattattttaaaggaagccttgagtctaggaaaaattgagacatatggaataaattactaacccatttctccttgaaatccattagatgtttgatgattcttcacatatatttctgaactgaaaagctagttgggaattatttttataagcatatccttatgtaatatattgtttctaagagtgaatggaaggtttaaagattaaattattctatccagagaataaaaaacaattatttcacaaggagaacatgtgtatgttgacacgacattttaaaatctagattttaaaataggtcccatataattttgagtcaattagaatacgtttgtatcagtctgtctacagttttacacctgtcaaatgttacttgaactaaaagaagtaccttgaacaattttgaaatttattattcctctgaaactgatgaaaagaatgacggtagagtgaaatttggattggcataatttaggagagaaattattccttggagatcaacctctgccaagatagtttacaatgacattgatactttttgatttacacaatttgttatataaaaaatactaagacgatgacagataatacacagactttaattaaaattgtactaaaattaaaagtctaaataaattacaagtgtacgtggtacatctaaacgtatgtttatatattttatttgtgcattttattcctagggttccttttgctttagtttgtaaaacgttcttatttttatggcagtgtagtatatactaaataaagaaaaatcaggaaatagaaaatgaagaagaaaacattagctattgtcaaccaaataaaaattgtgcaatctctaagtacatgaacgatgtattatttgtacagcatgtacaatgtttatgcttcacagggtgaggtagagactgcaaaacattgaacctgggacaaataagaaagaaaggaaattttcacaatatattaatattacagaaaatgttgaacttaacagttaagatacaagtagtgaaaaatgatagtatttaaggagatctagaaaatgtcatccataccagtaatgtgtgagaagtattagaataatgcttgtatttctggattggcatcgatttctattgagactggaaacatactagaagtgagcaaaaaagaatttaaatagtggatacttgagttttatacctaggagttcgagaaatacattttgttactatcaaagcagttggcacaagagtgtacaacattccctaattgtgtctatgtggtgaagacatagacaaacagaaaatagcaaaacagaaatagcaaaaaagcacaaataaattttacctgtatttttacgtaaaagccaattagagtaggaaaacatgaaatttgtgttttatcgaaatttttctcttatagtatagttgattatattactggaaaaaaattgaagcattggtatgttcacaaaaaaaagtaaaagataaggtcaaaaccatgggaatgcagggagcagacaaaatacacctaaacactgatactgattttgccctacggacatgtagcaaaatgaatgagtgcagattcctatggtcatacatcacataggacagtaaagaaatacatagtgtttcccaagatagggcatcacacaggagctcttccctaaagctagcaccaaaatttatctcctcagtataaagaagaatcagaggtaaattagtctcatttcacattccctggaaatggcaaataaaaatgacttgagattggacagatttaaagaaactcaatcattaatgatttacagcaattaatttaaaaattgtttaaatgtgctgtccaaacatacgtccaaacacctttaggccaagaattaatataatgtggtcccagaatggtggtgcctttagtagactcacaaaaaattcaaattctctttggcaaattttcttcttactaatatgcaaaagtgcacaataataattttcagagaaaaataaatctttgtcattcaaaggcatctaagtacgcaaggaaatgatattccaccatttgaaaggaaagcagaaaaagagtacaaacagatccacagagtttcattagtagaaatatcactgttagattataaagcacatttgctttcaaaaaatttaaaaaaaggaatatatttttaggagactaaaaagttgatgtagtaaatttgaaaagtagtttgtatgtagtattttaaattaaaaactcaaaaatgaactcatcagattagacatggccatggtgagagctcataaatatttcagaatgcattacagaaaatttaaaaaaaggcacaatgtggacagaatcatgaagagacatggaagatacagtaagaaagtgtagcatgtgtttagtgagtgttctcatagaggaagggaacggggaagggacaatatgtgatggtattttggctgaaagttctctagagttttgtaagacactaatccacatattcaaaacttctatgcatgctaagcaagctacgatggagataaacctacatctacatatctcctagagaaatagtaaacaatcaggaagggaaaaatatttcaattagcactagaaaaatcaaattacctttaatcatattgaaatctgaaagcatgaaaggtaaaataaacaatattatttgttaagaataataatgccattctgaaatcctcaaccaagaaaaatattcatcaacctatggctaaatcacatatttagagacaaaaaacaaaacaccaccagcagaattccactaaagaaactcaaaggaaactctgaaaacacgcttcagaaagattgaagttctgaaatcaaagaatgaacacagagcaaaatatattgtaaacataaagatagatcaaaatagaaaattaggtgttgaaacaaaagaatatttaaaattagataagcactgcaatatgtatgttaggaagcaaattattagggctgaagtattcaaagaccccttaattgtctgacaagagcagaaaggtatgactttgcaactcttttttttttttttttttttgagaaggagtctcattcaccctttctcccaggctggagtatggtggcgtcatctccgctcactgcaacctctgcctcccaggttcaagcaattctcctgcctcagcctcctgagtagcggggattacagccgcgtgccaccctgcctggctaatttttgtattttagtagagacggggtttcaccatgttgatcaggctagtctccaactcctgacctcgtgatccacacgcctcggcctcccgaagtgttgagattacaggcgtgagccactgcgcgcgaccgactttggaactttaataaattgactggacattatgcatttctctgttgtatctatgaaaacaataaaaataaaagtcataattttaaaacaagaagacagaaagtgataggagaaaatgagacattttatatatatatatatatatatatatatacacaacaaattactaatacaaaattaagtataaatgatcaaagattaacttaaacctaagtagacaatgtttttgttaaaatacaaagattggcaaaatttaaaacatccgtctctatcatagttacaagagacacaactaatatataaatttacagaaactttgaagttcaaacaatacagatactgtgtatatatgatatacatacaaacatactacatgaatataattttttaaaaagttgctatgtagaccaaatagaatgtaagttagaaacatttattaaaataagttagtgtaaccagtgtgataaaagttttaagttattaagaagatgtgatgacttaaatgtgtattagcctgatacatacatatatatatacacacaaaccacacactctctcacacacacatacacacacgtatttagagagagagtcaaattatataaagcaaaaatatcagaaagtaagtagaaatggataagcccccaaatattatagacatttcaaacacacgtctttcagtaatagataaaagaaaaaattaaaagagtaagttttaaaagaagctagtggattttaaaacgggcaaatattatataaggaacttgaatattataattcatgttattttcatgttcatacagaatacttacaaaaattaacattttctagaccataccacaaattcaaacaattttcacggaaataacgtgacacagaatatacgtcctaaacaaacagcaatgaaggcagatatcaatacaaaaacgaaagttagaaacataagtgtaataatattggttggaagccattttattgaatattgaaatattttaaaggtgaatagtcactacaaataaaccaaacacttttgtgaggccactaagatacatgtgtaatgtgtaatgcctccttttataaggagtaaatctgtaaaatcacctgggctatttgacaactgcaaagtgaatgtgagaaggagagaaacagtgagagagagagagataaaagcagtaaaataaacataaagaatgaaggagatagccaggcgccattgttcacgcctgtaatcccagcactttgggaggccgaggcaggtgggtcacctgaggtcaggagttcgagaccagcctggtctaacatggtgaaacccactctctactaaatatacaaaaattagcctggcatggtggcatgcatctgtaaccccagctactcgggaggctgaggtgggagaattgcttgaacgtggggggtggaagttgcagtgagtagagatcacgcgactgcactccagcttgggcgacagagcaagactccgtgtcagaaaaaaaaacccaaaaaacaagaaagaaaaaaacgaggaaatagtacacgaaaaagcagaattaaagcaactgggtatatatttaaaaatgcaaaagctcactttttcagaaaaatattaaaatattaaatctaacaaatatctaggtagactgatggagaaaaatacagaaaatgcacaaaaaagcaattacctggaatgcgaacgttacaaaacgtcagcagttgtagattttaaataaacaatgatttttgagttcaaccatgatggggcatattgaaaagaatctctcagaaaaaaagaaaaagaaaactgttataaagctatgtacaaaatgttaagcactattaaagtcttccaaatctaccagttacggagttattggtcttggactaacactcctgaaaagaaaaaaaacaaacaaaataagacaatacctaaaaacctggataaaatggcctaccgtgggcaccggcaatgcatccaagcaggtaggacctgggtgctacattctctttgtcagaacacaaagcattcatacactcttctcaccctcactttcaccttttaatctttgatctactattaaatgtattcaacattactatcaatcctttgctcaaaatttctttactcacattttgcttgatgcacttggatagactgttcaagaaagtgtgagtagtgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcactacctatttccagaattactctacagctatgaaaatcaagattatgtgttttgttgaaaaaaaaaatggaatatatatcagtggaagagagaatccagaaatagatactcacatgtatgtctaattgattcttaggacatatatatatgtatacacacacacacacaaacgtgtgtgtgtgtgtgtgtgtgtgtatatatatatatatattcaccgttttgaagattatcatctccaaatagggaatatatatatatatatatatacatatacagacacacacaaacacacacacacacatacatattgcagtctgataagataaacagcacattgaaacaatttctcaaaagacttgaatagatacttcagaaaagaagatacatgaatggtcagttagcataggaaaagatgctccacggtttagtcatcagggagatcaatcagtgcaacaatgagataccagtacatatccataagaatggctaaaattaaaaaggctgaaaatagcacctgttggtgaggatataaagcacttggaagtcttatacttgtaggaatgaaaaatggtatggctcctttgaaaatctaacagtttcttaaaggttaaacataacacaaatcagatagacagtcattcccttcctaggaatttacacactgtgtctgcacaatgatctgtatgtgtgtttccagaccaacctgaggggcgggctgctatttctcgtggctcagtaacaagacacagatgaactggggaggaagagagttttgacttctgcaactggttacagggaaacggcctggaaattatcaccagaccaactcaaaattggaaagttttcctgggctaatgtaccttctaagctatatgtgtatgtggaagtgtgcattcatctaaatacataagtgattaacttcttttaatctataactaagtctgagtcctgaagaccttcctctggaacctcagttaaattcagttaatctaaatgggtctaggtgctgggggcccttatcttgtctcctgctaaatcacagaggtttggagagtcccttcagatctccaataaacttgtttgtggaggcctggggagtttcttcagacccccagtaaaacttatttaatactaaatggctcctgttaagaatgccttcgttatttcgtcatgctttaaggcccaggaaaaacctaggcaaaactcttggtgggcttttgttacattccagcctttgtataagggcactggcttcttttttttttttttcctcttaatatttaattgaaccactcagtcggtactgaaacagttgttacggaggcctgtgttagtgagacctggcctgccacgtatggatgctcatgatagtttcttcataatagcccaaacgcggaatgatagaaatgtccaataacaagtgaaagtacaaacatacatggtatagccacatgaaggaatactactcagtatttacaagacattacagatggattttaaaattacattgatgcatgaaagaaggcaacacaaaagaacacaggtatcatttcatttatagaaaatggttaaaaatgcaaacggacctgaagtgacagtggctccttggggctgagggttgaaaggctgatgaactgcaaaggggtacaagaaactttggggcatagggaatttcctctatcttggttgtggcagtagttccgttagtgtatccatttgtaaacgtgcattgaattacacattttaaagtggtgcagtctgttgtaccgaaattatgcctttataaagttgatttcatcatcttaatttctccatactagcaattagcagctagaaaatgaaattcaataaaacataatagagattaatagccagaatcattacatgcttaacaatacatgcaatgaagcaggtacaaggcccctaaaagcaattggtgagaaaaattaaagaaggctaaataaatatatatcatgttcattgattggaagactcaattttgttagcatattacatcaacacaattctgattaatatttctagtaggagattttagagaaatttgaaagctagtttcaaaatgtatttgaaaatcaaagaacctagaataagcaagtcggtcttgaagaagcaataagttggaggacttactctgctagatttcaaacctgattttaaagctacagtaattttaaaacagtagtaatggtgtaagtattcataaatatatcaaagtaaaagaatacagattcaaacaatatgcccacatatgtacagttattgatttttttttagtagaatcttttttattcataaaaaatccatcaaaacaaaaaagttttccagccacacacaggaggggtatgggtgggggaaggtgtctgtccatctatccctggcccccagcccatgtggttttggcagcaataaggtgtgtggggtaatgacccctgaaattaaaatggtgtgtgtatgtgaaggaaaggcgggcaaagctatggggagcggtggagtggaaggaacaaaggaggtcagtactgggaacgctgaaggtgggaggccatttcataacattacttgttgatgaaattgccatggataccttctttgcccatcagcaggcctagcgtcttggcagtcatggtgacaatgacgttgaaggtggggactccaccgatgctcttcatatgaagatccacggtcaattccccatcctgcagcagtgagtccaggaccacagtatatttctggccccccagtgtcagtccattcatgacaaagtttgaccagtctttgccaaccaggacaccaacctcagctggcgtgatgttgaggaaggttttccctgggatggcggcccagatggaaggtgggtccttgttgccaacaatggccgtgtcctaacaggtcccgtccgccacgaggctgtagatggaggtgtccacctggccgttgcgttgctgcaggggctcctctggtcgctgctgttggggccgcctgggctggcgggtgggggaggcggagagcccgatgcaggtgctgtcctcctcgccacgactctgctagctgtgcagtagccctcgctccgccacttaaaaaagaaaaaaatatatatatataatatatatacacacgtgttatatatattgtataatatatatacatgtatacatgtatatatgtgtatatatatatacatggcacacgtgtatatatatataatatatacacgtgtatatatatatataatatatacacgtgtatatatatatataatatatacacgtgtatatatattaataatggcctacatctatattaataatatatattattaatatatatacacgtgtatatatattatatatatatacacgtgtatatatattatatatatatacacgtgtatatatattatatatatatacacgtgtatatatattatatatatatatacacgtgtatatatattatatatatatacacgtgtgccatgttggtttgctgcacccattaactcgtcacttacattaggtatatatcctaatgctatccctcccccagccctcaccccatgacaggccctggtgtgtgatgttccccgccctgtgtccaagtgttctcattgttcagttcccacccatgagtgagaacatgctcgcaccgccgcttctaaatgttttaaaaacaaagacaccaatgcccttcattggggaaatgaaagacttttaagtaaaacgattttgagtgaaataatatttgttgttttaaaaagttaatattaaccactctccatcatatattgaaattaacttaagatgtgaaagttaaattagaaaccttgtaaaggaaaaataggaaatagtttcatgaacttgacacaggaaaatatttcttagactagatactgtagcactcaccacaataagaaatcaagcgaattgcacttcatttttaaaaagcttctccttattatgttgttgtttaacaacttaaacgctatctctagaccaggaataattatttgctatataatacagcaaaaaatatgtatgtataaatggactcattcaaaatatataaagaactcctattacaaagaaattgacaaacagcccagtatatcaatgaatataaaaatttgagaagatattttccataagaagatatctaaatgaacattaggcatgagaaaaccaaattttaggatatcactacacacctggtgtagtttaaaagactgaaaatattaagtgtgtgggaatgtagagcaactggaaatggcctacatctttcatagaaatgtaaaacaatacaaatactttgcaaaactctgtccaacattttctacccattcaccaagcaactccatccctagctatagatacccaggaaaataagtatgtatcttcacagaaataattgtatgagaatattcatagttacttatgcacagtagttaccaagtaaacctgtctcccatcagaaaaatggatatcaaattgtgtgataatcatacaatcaataggatattacttggccaaaacaaaatgaaacaagggaaaaacacaatcaaacaaattagtggcatatatacccacctgagtaaagagaagtcggccgggtgcggtggctcatgcctgtaatcccagcactttgggaggccgaggcggcagatcacgaggtcaggagatcgagaccatcctggctaacacagtgaaaccccgtctctactaaaaatacaaaaaaaaaaagaaaaagaaaaattagccgggcgtggtggcgggcgcctgtattcccaactacttgggagtctgaggcaggagaatagcgtgaacctgggaggcagagcttgcagtgagcctagatcgcgtcactgcactccagcctgggcgacagagtgagactctgtctcaaacaaaaaaaaaaaaaaaaaagtcaaaacaagagaacatactaaatgattctatttttttatttatgatttcatgactaccattaagaaaatataacctgttgggaaactgtttctgccttgatgatgttgtacagacaagagataaacagtgaggaatatgcttagatgtattgggaaagacacgggtctgtggcattgtcacaagggtacacgaatactgagagtgaatgctgaaggaatgatccccattggtggtgaccctcaggtgagactagggtgcctgtgtttcagcaaagcctgggcaattggaatgcagggctcctaagattccatgacacccccaccttctaattctgttttgcaactgcagacggttacctggcacgctggccacaatctacctcactcttatcagagtctgcgctactgacagtgctttcagctctgagttgaggcacctcgaaccttgtttttgtggtgaaggatcctaaagtgctgtggggagtgatcacatttttgacaacagtaagttaagaatttcagttacttacatccctcagtcctgattaaacctatttgatttcaccagtttttaacccatcatatgtttgggtttcttctccccagtccctgactccacctcttctgccacaaacgtcagcatggtggtatcagccggccctttgtccagcgagaaggcagagatgaacattctagaaatcaatgagaaattgcgcccccagttggcagagaagaaacagcagttcagaaacctcaaagagaaatgttttctaactcaactggccggcttcctggccaaccgacagaagaaatacagtaagatctataggctcaccgtcatgaaagtgatgaatgatgtcctgtcttctctctgagacactaaatgctctctccatcaaaaataatttcatccttcctgtacttctaggaaaacagaaatgggtattttaacattttgttaaagttggaagacagaggtaccaaagtatttagcaactttccatgtttgcaatcaggtgggggtgggactagagttaaactgccatttattgatttctgacacaggcacagaatgacctgttttctccaagaggctcaatcatgttttcaagaatcctctctgtaccatataagatcctgcagacaaataacatctagtctgttgttctaaatgtctgagactagtgaacttttattcagttcaagtttctgtggaggcccaacaggcaaagctctgttctagtgactctgagggaaacttggtgatagtagccagtacctgctctgaggggcttcaagaggagtctactcctaatagaacctgtgctgtctataagtgacagcatcaagagcagggagtaggggccgtgcatggtggctcactcctgtaatcccagcactttgggaggctgaggcgggcagatcatgaggtcaggagtttgagaccagcctgggcaacatggagaaaccccatctccactaaaaatacaaaaagtagatgggcgtggtggcaggtgactgtaatcacccctgcctaggaggctgaggcaggagaatcctttgaacccaggaggctgaggttgcagtgagccaagattttgccattgcactccagcctgggcgacagggcaagactgttaaaaaaaaaaataataataatgataaataaaaataagaataaaaagcagagagtagcttggtgagagtgaagtcctgcttcctggggcacagagtcttgttgctaaagaggaagaaagatcgcatccgagaatgtgtggagatagcagtgcagtgtacagagcagggactgtgggcctgtctactgggctccatccaagttgcttgtcttgtctgtccctcagtttcctcacctgttcagagggtactacaataatacctacctctgtaaattgctgcagtgaattacatgagctatttcttgtcaatctcctagaacatttattggcacacagtaaacactatctattagttgttcattctgctgtttctaaattaacacaaactttattagcatttgggcatatttccttcatggccttatggtgttatgtgtcactctttatgcttcagatatgattcttaaaatcataactgaagatatgatttaaaaatcaaagattttaaaaatctttcacatacttgtccttgaaattcccagtaaaagggaaaccatcagtcccatagtcctaggggccttcccgactgtacgagaaatcactacttcatgccccagtgcagtgttttagaggagaggctgcaaggcttgggaaagtggccccgcattcagagtcagacctcagggactgtgaattctgactccacttcgttgtggttgaatcatcttgtcaacttccttgatgtgcccttgaggttctctttcttcatctctaaattttggaggatcagatgccagaaagtcaggagactgaagagtaaagatgtggaaatccctgtctagaccctggtactggggagagttttgtccttgggatggacctggctcctgtcctgtaggcaatgaccacagcagcatgtccagccttccactgaggcaggcgtgtctgtcttttctcagaatatgaagagtgcaaagatctcataaaatttatgctgaggaatgagcgacagttcaaggaggagaagcttgcagagcagctcaagcaagctgaggagctcaggtgaggggaccccatgggggcaggcaggggtcaggtgtgtaaatctctgaagtacagcagctcggtggggagatgtaagagctaagctgggccaggggaagggcaggaattgccatggcaggctcgctacacacaaatatttatcaaacagagaagaaggataataaaaatgtatgggttgcagttgtttctcagagccttgttttctctttttcaaacaagtaattgttgatgtgaaatttacataacacaaaattaaccaaaggagtgtgaaccacacagcagcattcagtatactcaaaatggtgtgccatcaccaccccacttacccttagtgagaatcacctcctgactgactgcggcttctcattctttcactcaatcaatgttgccttctcgaccctgtcattcttttcttctttcgtcttttcaattcgccccatctgcacctggcctcatttctgtacatggctttgtatctagtggccgcaagatgcactatgtgtattttcacatggaaatgtccatggccagagtgaggaactgaaaggatgtctttttgaaacggaattaggaagacacctacttttgtttacagaagagaaagatgaatggaacatcatcgaggatcttgcaggagccctctctgatacagaggaagcctgtaaaccattttctattctttctcttggccacagacattcctttaaacatgtgctgaccttctgcttcgaggtctccttgaggacattgtctcagaaatctctgttgcaatatttgagcggatcactcaaccctttccactcttaaattttctctaccgtctcaccttaggcaatataaagtcctggttcacgctcaggaacgagagctgacccagttaagggagaagttacgggaagggagagatgcctcccgctcattgaatgagcatctccaggccctcctcactccggatgagccggacaagtcccaggggcaggacctccaagaacagctggctgaggggtgtagactgacacagcaccttgtccaaaagctcagcccaggtaaggtggccataggccctgatgacccaaaatcccaggcttatgagagactccagacctccatactttcacaatgacagttgtatcaatggtgtttttttccactaagcttatgtggccatgacatgaccaggacttcttgggtaagagcggagatgggaaacccatggggttggaggtcacagtattgcaagtgtccctcctcccttgatggaaggtggtctttggagtatgaggcagcatctgtctagttttaaaggacaggaaggaggctgcgatgggagcaggcttgttagagtgaaaagagctctggactaagaatgaagattcccaggctgtcttttcggcaatgttcttagtaactgtcagagagtgaatgacttgtccttcctgaatttctctctctccgtggcagacaaattgtctcttgcaagggtctgaagcattcaaatgtgggaacacttacaactgctttccaaaatgagatgaaggccctcgccgtgtgatgttggagaaggcactttatgtgggggcgttttgtggtaggaagtgcttcagactggagcactccccatggatagaatgtccctgaataacacagcagaagccacttggaggcttgaaatcttctgatgcatagaggactgtgggacaagtttgtctgcttctaagagaaagaattaggtttgaaatgcaaactgtgacgggacaccaagcctgtgcctgggaatcagatctggcaggatgggggacacagctgccaatgtccagagagaggctgcacaagcctccagtgatatgggaagcaaaaggtcttttcaatatttggccacatcttgatggtggccctccagatcagaaatgcattgcctgatggatcaggaaaccatgccagggcattctgttaaagataaaacatgagagttttcagttgaacggtgacccatgcctagatgttcatgtctctgttgcacattgggctgactgtgcttgcagactgtgaagtgggaaatatctgaacgaacacttctgtatttacagaaaatgacaacgatgacgatgaagatgttcaagttgaggtggctgagaaagtgcagaaatcgtctgcccccaggtaacactgaatactcaggaacaattaatggatggtaacatatgaggaatatctaggaggcacaccctctctggcatctatgatgggccaaaaacccgcattcgcttggccacagtatgtgaaatataacccagcttagacacagggtgcggcagctgtcatgtttctctgtgtgtgccgagtgtcatgtctgcaccgtacagggatagctgagtcttcatcctcctcagctcctatctgtccagtgcaatgaacagcagctgctctcttcctctctggttcccatggcagccatgctctgttgcagagagaacaggattgcatgttccctcttaatgggaacgtccattttgctttctgggaccactctcttaatgccgcctgtcaaaaccagctaggactccctggggtccaatccctctgtgtttaatcttctgtcatctctgtcccacctggctcatcagggagatgcagaaggctgaagaaaaggaagtccctgaggactcactggaggaatgtgccatcacttgttcaaatagccatggcccttatgactccaaccagccacataagaaaaccaaaatcacatttgaggaagacaaagtcgactcaactctcattggctcatcctctcatgttgaatgggaggatgctgtacacattattccaggtagcctctgttttccttgtgtctcgtacctctctctaggctgaggaagataaactctgaagacaggctctatcaacacaaattcatttgaataaaaaactgtgatgggtttctaaacagatatcagggagtttttttgtccttctcagctaatgtcatgcctttgtctgccagtccccagtatcaagttactcaaccccaggcaagtgtgacaatctcatagtcacctgagtgcaggaggtgcacaggccatatctgtcaggcctcctagcttcgattcagtatttcttgtcatctgtgattaagtcatctgtccctgaacaatgcccatggagtttctatgcctgtttaaggaagctggcagccttgcctttgtatttggaaatatcgttccccaggcttcactgctctcagctttcatctggatctcctttaagtcagcttgcttagctgcacagtcaccctgaaatcaggacggaaacttttcttctttactttgctgatatatttccataaagcaaggctggaccctggttctccaccctgtcaatgcaatggctgatccaatgtttctttgtagcatcgtggattttttttttttttttttttttgcgatggagtcttgctctgtcacccaggctggagtgcagtggcaccatcttggcttggtgcaacctctccctcccagattcaagtgattctcctgcctcagcctcctgagttgctgggaccacaggtgcacaacatcacatctggctaatttttgtatttttagtagagacagggtttccccatattggccagggtagtcctgaactcatgacctcaaatgattcacctgtcttggcctcccaaatcacagattctttttaaagcaagagttgttcaaatttatctatcagtcgtgtttcatgtatagatgcctctaaacatttaatgtccatgttacctggtgatataagtccgtattgcagcaacactcttagaaaattgtttgaccaatttttggagatttttttggggaaaaaattttgtttaactttgactcaggcagggaatatggcattatggtctacacgtagagggagattttggcctgtgggtctggaaagcagggtcatctaattctcaccaaagttaatctaggacaccctagaatattcctgtcagaatccttattcttgcactgagaatagttatgtccttgtgctatgactggacagtgatttgttcctatgtgaagtatgaattgcttaatgtgacctgcttctctgaatttatttacagaaaatgaaagtgatgatgaggaagaggaagaaaaagggccagtgtctcccaggtaatgttgtggaattgttggctgttaattcagtagtgacatctggagattgtagatttagggaaaatgaggaagtgatgaatagaactatttcttccattcacccagctacaaattgtgctgatttacaatgttgtatgttatttgtggcacttgtattggttttaatttcatagtcctctcaagataggaacttgccatcagatgagccaggtgaactagccaaacagggttttcttgttgatcttttcaaaaaaccagccctggattcattgattttttgaagggttttttgtgtctctatctcctttagttctgctctgatcttagttacttcttgtcttctgctagcttttgaatttgtttgctttgcttctctcgttattttaattgtgatgttaggatgtcaattttagatcttttctgctttctcttgtgggcatttagtgctataattttccctctacacattgctttaaatgtgtctcagagattctggtatgttgtgtctttgttctcattggtttcaaagaacatctttatttctgccttcattttgttattttcccagtagtcattcaggagcaggttgttgagtttccatgtagttgtgcggttttgagtgagtttcttaatcctgggttctaatttgatggcactgtggtctgacagtttgttgtgatttccattcttttacatttgctgacgagtgctttacctccaactatgtggtcaattttggaataagtgtgatgtggtgctgagaagaatgtatattctgttgatttggggtggagagttctgtagatgtcttttaggtctgcttggtggagagctgagttcaagtcctggatatccttgttaagcttctgtctcattgatctgtctaatattgacagtggggtgttaaagtctcccattatgattgtgtggagtctaaatctctttgtaggtctctcagacttgctttatgaatctgggtgctcctgtatagggtgcatatatatttaggatagttaactcttgttgaattgatccctttaccattatgtagtggccttctttgtctcttttgatctttgttggtttaaagtctgttttatcagagactaggattgcaacccctgcctttttttgttttccatttgcttggtagatcttcctccatccctttattttgagcctatgtgtgtctctgcatgtgagatgggtttcctgagtacagcacactgatgggtcttgactctttatccaatttgccattctgtgttttttaactggggcatttagcccatttacatttaaggttaatatcgttatgtgtgaatttgatcctgtcattatgatattagctggttatttcgcccgttagttgatgcagtttcttcctagcgtcaatggtctttacagtttggcatgtttttgtagtggctggtaccggttgttcctttccatgtttagtgcttcctttaggagctcttgtaaggcaggcctggtggtgacaaaatctctcagcatttgcttctctgtaaaggatttatttctccttcacttatgaagctttgtttggctggatatgaaattctgggttgaaaattcttttctttaagaaggttgaagatgctggagaggatgtggagaaataggaacacttttacactgttggtgggactgtaaactagttcaatgattgtggaaggcagtgtggcaattcctcagggatctagaactagaaatactatttgacccagccatcccattactgggtgtgtacccaaatgattataaatcatgctgctgtaaagacacatgcacacatatgtttattgtggcactattcacaatagcaaagacttggaaccaagccaaatatccagcaatgatagactggattaagaaaatgtggcacatatacaccatggaatactatgcagctataaaaaatgatgagttcatgtcctttgtaggggcatggatgaagctggaaaccatcattctcagcaaactattgcaaggacaaaaaaccaaataccgcatgttcttactcacaggtgggaattgaacaatgagaacacatggacacagaaaggggaacatcacacactggggcctgttgtagggtggggggagggaggaggggtagcattaggagatatacctaatgttaaatgatgagttaatgggtgaagcacaccaatgtggacatgtatacatatgtaactaacctgcacgttgtgcacatgtaccctaagacttaaagtattaaaatatatatatctgtatatatatatatacatacacacaaaaaataataaaggaaaactatacatatggaaaaaaaaagaatgttgaatattgctcccactctcttctggcttgtagggtttgtgccaagagatctgctgctagtctgatgggcttccctttgtgggtaatccgacctttctctctggctgcccttagcattttttccttcatttcaaccttggtgaatctgacaattaagtgttttggggttgctcttctcgaggagtatctttatggtgttctctgtgtttcctgaatttgaatgttggccttccttgctaggttggggaagtcctcctggataatatcctgaagaatgtttcccagcttggttccattctccccgtcactttcagtacaccaatcaaacgtagatttggtctttccacatagtcccatatttattggaggcttgttcatttctttttactcttttttctctaaacttctcttctcgcttcatttcattaatttgatcttgaatcactgataccatttcttgcacttgatcgaattggctactgaagcttgtgcatgcaccacgtagttctcgtgccatggttttcagctccatcaggtcatttaaggtcttctctacactgttcattctggttagccattcgtctaatcttttttcctttagctcagagaagtttgttattaccgactttctgaagcctacttctgtcagctcatcaaagtcattctccatcctgctttgttccattgctggcgaggagctgcgatcctttggaggagaagggatgtcaggtttttggaattttcagcttttgtgctctggtttctccccacctttgtggttttatctacccttggtctttgatgatggtgacctacagatggggttttggggtggatgtcttttttgttgatgttgatgctattcctttctgtgtgttagttttccttctaacagtcaggtccctcagcttcaggtctgttggagtttgctggaagtccactccagaccctcaaacagggatttctttgtgttgcctattctctcccatgtgtttaaatccagggagaggtgtatacatgctttcttcctatttgttggtagtatgttggctagtatttttgcaagaaaagaaattgaaaaagtaaatatattatatcaaaatattgggaaaatggggcccttaatacacaagatctgtgtctgcactgcgtcaagaactctcttcacttgaatgctgcatgtaaaattcaacccaatttatgcaaagtagttgaagccctgtgtcagttctctgtgctgcaagtcatgatggtagtttacagggagagtctgggtgccctgagttggctcatctgtggcaaatgtactgagcacatgctgcccatttttgctgtgtccccagagcagtcaccctccaccctgtatttagaaggatagttttatttctcttgaaggaaaaatgcctttggtttctgtgaccactccattctgtctcccatcagatcatctgggaggttttgttgtctaatgtctgttggttaaatcttctatcatccctgtcctgcctggctcatcaggaatctgcaggagtctgaagaggaggaagtcccccaggagtcctgggatgaaggttattcgactctctcaattcctcctgaaatgttggcctcgtaccagtcttacagcagcacatttcactcattagaggaacagcaagtctgcatggctgttgacataggcagtgagtactccattgtgaaggtgataaagctccagttcatggcccaggtagaccccataatctttgggccttgtgccccttgttgggctgagatttgccatcaccgtgggctgaacctatatatcaatgtagatttcaatcactctggagtcgagtctgaagcacaggcatggggtgggtcagtgagctttgctctcttcctagtctcaggccatgcccgtgccaacctggactgactgtcacgacattgaactcaaggcaggtgtggcaaactcacaccaaactatgcagcacatgcccaggagctgtctgtcagctcagctcatctgaattaaatgtctcttgccagctacaaaattccttatgagttttgttcccaaagcatgtctgtgtggttctttacctgccgaaggccagtgtcacccttgtctacctctcagtgaaagatgtgacccaggtttcactgaatttattcccattttctgtgtcttctaagttcgcttgttttagctcatctgtccatcatgttcctggtacgttttctagataaacagctgacttttcacccacaaaagccataatagctgatgcttctgtgtagaaccaagtttcattttgactcaagagctggtacattgcaccccttcatcaaatctctgtgtccacaatctcataaactatcaaattctgggtatttaatgagagaaagcttaatattgaagtatctctcctatgaggtgttagaactatttgcctacaatttattggggaaaaaattgctcatttgtgtacataaacctaggacagagcacatagggaagataacattccaaaacaggggaattttgcccaaggctcatgaaagaacccaagccagttttctcaagacttgacctcaggcctactggaatatttctctcaaagtctcctgttctcacactgacaagactgatgtccctgtgttaggattggacagaggaatgtttctgtgtgcaaggaagaactgcttaatgtaagagggcccatctgaatttatttgcaggacatcggtgggatcaagtgaaaaaggaggaccaagaggcaacaggtcccaggtgagtctgagaaattgtggagagttaatttgatgttgacacctggagatgccaagtccagggaaaacagtacatgctgaaaataatgattttgtcttgtcagacaagtctgaattatgcctactacattgctttttggttctcattagagtaaatgtttaggtttccatttcttcctacacttatcatttactaacctagtgaaggttgaccatacctcaaaagctgtattctcatggtaactgcagggaaacttgagcacattttatgcaaaattattgaggacatgcttttcatgatcactgttcactgtgtgtcctgagagcacaaatacagagtgtcctttgattccctcatcagtgtgtcacctgaccaattcactgagctcgctctgtgtgtgtgtgtgtgtgtgtgtgtgtgtgtgtgtgtgtctttctctttcatccttttctacctggccctagtctatcccaacataaaggcaataatttgttacctcattaatggatctgtcctttttcttttcaaactcttccttatgttagccatgaaatctagctgggactgtgtggtttctgattccccctggcttattctttactttttcccacttttccaggctcagcagggagctgctggatgagaaagagcctgaagtcttgcaggactcactggatagatgttattcaactccttcaggttgtcttgaactgactgactcatgccagccctacagaagtgccttttacgtattggagcaacagcgtgttggcttggctattgacatggatggtgagtacctttctatgaaggtgataaggatccactgagtcttctggttagggtcatattcctactgcaagtggcccttactgagctgagagatgtcattgccacagggaggacctataggcacatgtaggttgaatgaaactctagttccacttggaagcccagacaagggatgggtcagtgagcaaggctctcttcctagtctcaggccatgcctgtggcgccctaatcctactctcatgacgttggacctgggcagatgtgacaaattcacacaactctgattttgtctcaattttgtagatcttgtagatttcatccttcactctaatttcagcgtctaaaatccttgctaccatgaacaatctgagtatttgatgagacagggctgaatagtgcagtttttctcctagcaaccatttgggggcatttgctttaaatcgattggaaaaatatggcataaccatttgcacaaacttgggacaaatgatattgggataacgatctaccagaatagggaattttacccacagtttctgggacaaaaaccaaggaatctctatcgtgatcagccttcaggcctcttgaagaatatctctcacagtgtcctattctcatgctgaggagcctgaagtccctgtgtgaggattagacagtggattgttatgtgtgtaggagaaccagcttaatatgtctgtccatgtctgaacttattgcagaaattgaaaagtaccaagaagtggaagaagaccaagacccatcatgccccaggtaactttgagcaattatggatgcttaattgtgtgttgacacctggagatgccaggtccagggaaaacaagagtgtgttcaatttcatgttttcaacgaaggttgaattactcctcctgacattgctgttggttttcattgcagtagatgtttaggtttccatttcttcctccccttatcatttactaacttactataggttgaccatacctcaaaggctgtatggcaactgcatggaatcttgagcaagtttatggaaaattattgagcccactcttttcatgaccactgttcgctgtgtgtcccgagcgcactaactcagagtgtcctttgaccccttcatcagtgtgtcacccggccaattcgctgagctcactttctcctctctctctctctccctctccctgtctttctctttcattcttttctacctggccctggtctatcccaacataaaggcaataattcattacctcattaatggatccgtcctttttctttttaaacagttccttatgttagccatgaaatctagctggggctgtgtggtttctgattctccctggcttattctttactttttcctacttttccaggctcagcagggagctgctggatgagaaagagcctgaagtcttgcaggactcactggatagatgttattcgactccttcagattatcttgaactgcctgacttaggccagccctacagcagtgctgtttactcattggaggaacagtaccttggcttggctcttgacgtggacagtgagtaccttactgtgaaggtgataagcctccacctggtcttccagataggggtgatattcctgttccaagtggcccttactgacccgagagatgtcattgccgcaggcaggacctatgggcgcatataggttgtaatgaaactgttgtctcagttggaagcctagacatgaaatgggtcagtgagcaaggctctattcctagtctccagccatgcctgtggcaagctgagcccgctctcagcacattggacccaggcagatgtaaaaaattcacagaactatgatttggactcaagggtttgtagatttcctccttcattctaatttcagtgtctaaaattcttgcatccatgaacgagctgggcatttgatgagacagggctgaatactgcagttttcctcctagaaatcatctggggcattttctttgaactgatgggaacaataaggcataactgtttgcacaaacttgggataaatgattttgggataacgatctaccagaatggggatatttcacccttggttctgagatgcaaaccaaagaatatcatgaccagctttcaggcctcctgaagtatctctctcacattgtcctgttctcatgctgagaagcctgagatccctgtgtggggattagacagtggactgttatgggtgtaggtgaattggcttattttgtctgtccctgtctgaatgtattgcaggaattaaaaaggaccaagaagaggaagaagaccaaggcccaccatgccccaggtaactgagcaattgtgaacagctacttctgtgttgacatctggagactcctggttcagggaaaacagagcgggctgacattatcgattacatcttttccagcaagcctgaattattcctactaacattgctgttggttttcattgcagtagatatttaggtttccatttcttcctccccttatcatttactaacctactgtaggtggaccagacttcaaaaactgtattctcatggcgactgcatggaaacttgagcacattttatggaaaattattgagcacagtcttttcatgatcactgtatgctgtgtgtcctgagggcactaactcagagtgtcctgttactccctcatcagtgtgtcacctggacaattcactgagctcattctctctctctctctctctgtgtgtgtgtgtgtgtgtgtgtgtgtgtgtgtgtgtgtgtgtgtgtgtctatctgtctttctctttcattcttttccatttggccctgttctgtcccaacatgaaggcaataatttgttacctcattaatggatctatccttttacttttttaaccacttccttatgctacccatgaaacctagttggggctctgttgtgtctgatttcccctggcttattctttactttttcctccttttccaggctcagcagggagctgctggaggtagtagagcctgaagtcttgcaggactcactggatagatattattcaactccttccagttgtcttgaacagcctgactcctgccagccctatggaagttccttttatgcattggaggaaaaacatgttggcttttctcttgacgtgggaggtgagtacctttctatgaaggtgataaggatccactgagtcttccatataaagatcatattcctgctccaattggccattactgagctgagagatgtcattgccgcagtgaggacctataggcacatgtaggttgaatgaaactctagttctacctggaagcccagacaagggatgggtcagtgagcaagactctcttcctagtctcaggccatgcctgtggcactctgattctactctcatgacattggacctgggcagatgtgacaaattcagagaactatgattttgactcaagggtttgtagatttcctttttcactctaatttcagtgtctaaagtcctcacaaccatgaacaatctgagtatttgatgagacagggctaaatattgcagtttttctcctagaaatcatttgagggtatttgctttaaattgattggaaaaatatggcataactgtttgcacaaacttgggacaaatgttattgggataacgatctactagaatagggacactttacccacagtttttgggagaaaaactgaggaatttatatcatgaccagccttcagacctcctgaaatatatctctcatggtgtcgtattcttatgctgaggagcctgaggtccctgtgtgaggattagacagtggattgttatatgtgtaggggaatcagcttaatgtgtctgtccatgtctgaatttattgcagaaattgaaaagaaggggaaggggaagaaaagaaggggaagaagatcaaagaagaaaagaagaaggggaagaaaagaaggggaagatgacaacccaccatgccccaggtaactttcagcaattgtggatgcttaattctgtgttaacacctggaggcaacagattcagggaaaccagagtgtgtttgatgtcatgttttcaacgaaggctgaattactcctactgtcattgctgttggttttcattgcagtagatgtttaggtttccatttcttcctccccttatcatttactaacgtaccataggttgaccatacttcaaaagctgtactctgatggccactgcatcaaattttgagcatattttatgggaaactattgagctcactctttttgtgatcacagtttgctgtgtgtcatgagggcactaactcagagtgtccttttactcccttaccagtatgtcacctgggcaattcactagctcactttctctctgtctctgtctctgtctctctctctctgtctttctctttcattgttttctacctggccctgttctatcccaacataaaggcaataaattttttttttttacctcattaatgaatctatcctttttcttttctaaccacttccttatattacttctgaaatctagtggggctctgtggtgtctgattttccctggctgcttctttagttttgtctccttttccaggctcaacggcgtgctgatggaagtggaagagcctgaagtcttacaggactcactggatagatgttattcgactcagtcaatgtactttgaactacctgactcattccagcactacagaagtgtgttttactcatttgaggaagagcatatcagcttcgccctttacgtggacaataggttttttactttgacggtgacaagtctccacctggtgttccagatgggagtcatattcccacaataagcagctcttactaagccgagagatgtcattcctgcaggcaggacctataggcacgagaagatttgaatgaaagtacagttccatttggaagcccagacataggatgggtcagtgagcatggctctattcctattctcaaaccatgccattggcaacctgtgctcaatctgaagacaatggacccatgttaggtgtgacacgttcacataactgtgcagcacatgccgggagtgatcagtcagacattttaatttgaaccacgtatctctgggtagctacaaaattcctcagggatttcattttgcaggcatgtctctgagcttctatacctgctcaaggtcattgtcatctttgtgtttagctcatccaaaggtgttaccctggtttcaatgaacctaacctcattctttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgaacaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttcaaaaaaagtaaaaagataatgtagctgcatttctttagttattttgaaccccaaatatttcctcatctttttgttgttgtcatggatggtggtgacatggacttgtttatagaggacaggtcagctgtctggctcaatgatctacattctgaagttgtctgaaaatgtcttcatgattaaattcagcctaaacgttttgccgggaacactgcagagacaatgctgtgagtttccaacctcagcccatctgcgggcagagaaggtctagtttgtccatcaccattatgatatcagcactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatattcatatctctacactgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttctggattgttttttacattcagtgttataatatttgattatgctgattggttttggtgggtactgatgcgaattaataaaaacatttcatttccatgtttattttctaatctcttccacattgtaggctatgtttaccatacgtagcagaatgtatttacatttcttggttctagtcatttgtattcttcgtgagtgtgagtgtgtgtgtgtctgtgtgtctgcgtgtgtgtctgtgtgtgcctttggcatttaggaagggttgtatagctcatgttaaatattgcactaaaaatgtttttgatggttttcctccctttgaactagacacacttctaatatttggtttatagttttaaattataactttcagcatcaaatatttccatacaacagtcaattacatgatgtgttttctttttactacctcctttacctgccacttctcataatagtatttgaacctaaacatataccggtgacattctgtgattatcatcttgcccctaccttggttttggtttttggtgcagttccaggctcttggtgtctttgtttgggacaccaagagcctggtactgcacggcaccagctggtaagaattaggcttttttggccgggcgcggtggcttatgcctgtaatcccagcactttgcgaggccaaggcgggcggatcacgaggtcaggaaatcgagaccatcctggctaacacggtaaaaccccatctctactaaaaataaaaaaaattagccgggcgtggtggcaggcgcctgtagtcccagctactcgggaggctgaggcaggagaatggcctgaacccgggaggcggagcttgcagtgagccgagatcgcgccactgcactccagcctgggcgacagagagagactccgtctcaaaaaaaaaaaaaaaggctttttttttccctaaggtttaacaacaaaccagccctttggaaagacttgcttcaccactgttaccaaccaacggcctgatgctttccctcagttttgtgattttgacaaaacaagcaagcagcattccctcctgataagagaccaccgacctaggaatgattctggccagactagagaggatgcacagtgagggttttcatgtcctctgcttcagcttttgatgtcagagggccacaaactccactctcagatgattgctaatgccaccattttatgaacatggaccccatggagaggcacgaagctcaattgcacttctgcacatttttcctcctataaatattgctattggaatattatttggtacggctcccgtgaaagatacatttgcagaatgtactcaaattagaagcatcatgtaaagcctataatgtaccgatagtgcatcaacttccctacactatagaaatatctgcggtgtagacatttccacaatgaccagatatgtgtacaacaaaggtggctgcagcattctttgtaatcctaaaacaatgaaacctacctcatctcaaaaactttatttttttatttttattttttttttgagatggagtctcgctctgttgcccaggcgggagtgtagtggtgcagcctccactggtgcagcctccactgcagcctccacctcccaggttcaaatgattctcctgcctcagaatcccaagtacctgggattacaggcacatgccaccatgcctggctaacaaaaacattttgaaaagggttaaataaatcatgcacaaactgaggaaaaatactcttcaaaaatgatggagaggatcactatgatgatgaatgattccactggtcacattattgatagagcaatcagtaaatccaggcacatcctcgggatattactgacctcctattattaacatatgaaaaaatggaggcatgtaaattactcgtttaagcgtataacggactgaattagaattttatcacaccagaagtgggttcctaggtctctgtttcaggattcctgagttacacacgtataaacccaggatttcaggagatacccggttaagaatccggtcggggaggtgggctggcccttgacatggataagtcacaaattagtggcttaggactccaggaagataaaatcttccccatttatctagtgattgacaatgcatgaatactttaaaagctcaaacaagcgtccctgggtgggctcgaaccaccaacctttcggttaacagccgaatgcgctaaccgattgcgccacagagacaggtactgtcagttctactgggcgctataggaagggcgcacgcacgaaacttcctccctcccttgcatcctcagggcccgcccggcaggacgactgagcaaggccttggaaaaccggagagattggagcggtaagtcgcgctggtcacgttggacacctgcgcgttgggagattctggagccagaaggatagccgaatggccttcgcccgccctgcccctcgcctgcttcagaaaccccccggaaacgccccggttgagaccccggcccgagccgcctgggggccctagggaggctgaacgcccggtggctcccgggatggctcttcccgttcttcgcgccgccttcacccagtgagggagcctgtgccctccctgcccagtcgcttttggggccgctgcggagcttccgctgccatcttcggatcctgtgttccgcacgggggctccaccagggcagggatagtggtgagggtggctcgtgggtccccctcgcggggagcagggtctggcactcaccagggcgcaggactaggacttgtcgaatgaatccatccttttagcttttagtcctttgaagagccttgagaatggaaatcatgagagatttttccatggggaagttccttttacaaagcatttatttacgtggacttcttggcaccccgcggggcggcaacgggcagggcctccagtgccccttctgcgccgtggagccgcgggggctcagctgggcggtggtcgggtcctgaggccggagggcgggagcaggggaggggaaaagcaaaagcggggaaagaagccggggagcggtggaccagacgtccagacctcctgaaaggctggcggggaggcacaggcgggatcttccggaggtgagaatttttttttattatagcagaatggggaggaattgaggggaaaatggagatagaacctgaaagagccccaaacgccagaacctgtagctccccaagaataagatcttccagaagaactagacccaaaactagccgttggggaacaccgaaatccttggaggagcaacatccgcatgaccctctgtgttcctttaggcaaaaggacttgcttccattgtttgttcaattgtttgtgtttgttaaataaataaaacgattttcatgtatctttgaaattactttggcgctactattttatgattgcaaataattcggcagtgatcattcttgtacacttctcattggccatttgtgtatttctatagggtagaggcctggagagcagttgctccagcatagggattacacagtttttgtttgtttgtttgtttgtttatttatttatttatttatttttgagacagagtctcgctctgtcacccaggctggagtgcagtggcgccatctcagctctcactgcaacctccgcctcccgggttcaagcgaatctcctgcttcagcctcccaagtagctgagattacaggtccgcgcgagccaccacatcgggctaatttttgtatttttagtagagacggggtttcaccattttggccaggcaggtctcaaactcctgacctcaagtgatctgcctgccttggcctctcaaagtgctgggattacaggcatgagccaccgcacccagcgattacatgttttttttttatatatcattctattttctttccttatttggcttattagctgtaactctttcttttgttatgtcagtgatggctttagggtccctaaatacatctttatccgtctgccatcaagtgacattatacctccccttctggcctttatgctagtgttgtcagggaatttgattttggacatgttataaaccccaacatccaagtacgtacatagcgattttcagtcgtctccatttctttgtgtaggttcagatttctgtttggtatccttatccttaggcctggaggactcctttaatatttcttgtagtgtggttcggtgaattctgtcatttttttgtatgtctttaaatgtcctgatttcagtcacatttttgaaagatatttcaatttggcatagaattctagaataactttttttctctcagtactttaggatgttgccactttgacactttgtcattgacatatctttcctgtttttgtaaacttggcataaagtgggtttcctgtacttgttatatgatttttggattgtgtattcaaattaaaagtattaaattaaaattaaaatggcctgggcgaggtggctcacacctgtaatcccagcactttgggaaggggaggcagaggatcgcttgagacccagagttggagaccaccctgggcaagatagcaagaccctgtgtgtgtgtgtgtgtgtgtatacacataaatatgtatatatattatatgtatgtatgtatatataagtcctacagtcaccttaagttccaccaacagtgcacttaaagtaaaatgtgcccaacctgaggctcaaacctacctgctggcacgcaatttgtgtttgtgagacaatctcaacagcatttgctttttctagcatagtggttttcctgttttcctcacatgtgaatgtcttcagtgcaaaacctgtcagaattcatttcctttgctaaaatgttttaaaataactcttacttcaagtaagtgcattaaaaataaacttctcagttgcatccctggaatccatggaaagtccaggagagacaatcaagtgctacaggatcaagcccaaacagaacaggactaggcatggcttcctcactaggagccaggccaaagtcatctcctttggtctccaatggaggccagaactcggttcacctgcaacgggaggacctggcccagaagaggtggccttcatcttcatggtgccttcagataggaaatctaggatttcttttcttctctttgatctacttccaactctccctttctatttatttatttatttatttatttatttatttatttatttgagacagagtcttgctgtgttgcccaggctagagtgcagcggggcagtctcagctcactgcaacctccgcctcctgggttctagagattctcctgcctcagcctcctgagtagctgggattacaggcgcctgtcaccgcgcccggctacttgttgtatttttagtagagacagggtttcaccatcttggacaggctggtctcgaactcgtgacctcgtgatccacccacctcggcctcccaaagtgctgggattacaggcgtgagccaccgcatctggccctccctttctatttcttcaagacctttttcggatccctcctgcgcaggacctaaacgggcggtgcccttacccactggtccctccctgcctggtgtcttcggagccctagctcacccggaacgttactgcccgccggtgacagcgagaggaccaaagaggaccaaagagggcagcgggtgtggtgggaaccacagagtcaccgcgcacctgcgcctcgcgggctcctcgcaaattgaataaacgccccctgaagcttctcttcaagtcacagggaaggggaaggtggctgccgacccggcgggagaagccggccctgcccctggtccttgaagacaggtttggccaggctgattttgactggtaggcccaaagaaaagcctcaagggcagaccaaactccgacaggctccgagattaaggctttcaaacgtctgatcgttttcagcttggtcagtaaaatcgatcccgcctttatcaggagattcctttgccaaagttcagagacctgggtttcccgctgcttgccacacagaaaaccgatcactgagacggttattgccaaggaagaggctttaatagggtgctgcagcggaggagatgagaactcagtctcaaatccatctccctgaccaaccaaaactagaggcttagatggcagggaaagaatgtgacaatgtgtaagaaaacaggaactagaccaggcgcggtggctcacgcctgtaatcccagcactttgggaggccgaggcgggcggatcacgaggtcaggagatcgagaccatcctggctaacacggtgaaaccccgtctctactagaaatacgaaaagaaattagccgggcgtggtggcgggcgcctgtagtcccagctactcgggaggatgaggcaggagaatggcgtgaacccgggaggcggagcttgcagtgagccaagatagcgccactgcactccagcctgggaggcagagggagactctgtctcaaaaagaaaaaaaaaaaaaagaaagaaaagaaagaaaacaggaactagggaggggcaaggaagcaatcaggatgaatgaggggtccggcgtctcattgtctgggtgactttcagttctttgatatcttttttgagaggcctgaaggaaggaactgaaataaaacaaatatcgagtttcaaactttcagatcagaagggtccatttctatgtttatccaaaaatctacgtatgggactattgggtgggtttcagaccaagaaagagtgtgcatatcaaagtctgcggttaaccaaagagaaaacataattttccgaccaataggatgtatgggggtcaaagaacgaccagcctacagtactgtttattggcctgagcatacggaaggatgaagttgcaccagcgaaatgggattaagctgcaggtgcgggctgggcgcggtagctcacacctgtaatcccagcactctgggaggctgaggtgggtggatcacttgagatcaggagtttgagaccagcctgaccaacatggtgaaacctcgtctctaataaaaatacaaaaattagccggacgtcatggcgggcacctgcagtcccagctactagggaggccgaggcaggagaattgcttgaacccgggagatggaggttttaatgagccgaaattgcgccactgccctctagcccgggcaacagaccgagacaccttctcaagcaaaaataaaaacaaaaagctgcaggtggaaaaaaaaaagtctggattttggttcagagtccctggggccttcctcagtagttttctctttccttaaaaaaggaagcttgtctcagtctctgcatctctctgagtccttttggagattgaggatggtgaggtctcagtgcttggcccccttctaactctgggtacctcccctcccgtgggtcaacctggtccagtgcacaggccccagctccgacgaccatctcccccctaccctttgctcccagcaaaggccatttctaggtcagtcgtgaggtacagccaggacagggcagctcgctccgagatttttggctctcgaaggccttgagcgctgtggttctgcagaacgctgtctgcctctggtggaggaactgacacccgctggagaaagtgtggagggaagcgagggctgcacctgcacgcaggagctgaggcaagcggcggttcccagctctcagtgcaaaagacatttgtcatctgagaggctggactcagttattataattttcaattttgtcaataaaaaccgaatggaaatttgttttcttacttgtagaaacctcctcacaagacctcccatcttacattccagggagacttagcagggtattccgccaagacataggttagactgcggttctgatctgcaggcctcgatgccctgcgccggggcaccagggcacgggcaaagccctccccctacacaaagcaagggtgttatgcctacaaccgaacggggacactaagagcccccaacatgcacggttttcattccaaagaaaaccaccagttctgagtacaacttccacctggctctattaactgagtacacgtttccccagcacagaaatcctacaaactcccgtgaatgctgtggtgaaaagcaggagctgccagggcaagatggatcgcacctgtaatcccagcacttcagaaggctgggcggaccacttgagcccaggagttggagcccagcctgagcagaatggtgaaactgctacgaaaaaagaaaaagaaaggaaagagaaagaaaagaaaataaaaaaaaaaagagaaaaaactagccgggtgtggtggcgtgcggttgtcctactcgggagcctgagatgggaagatcgcgccagttctccagcctggacggtacagcgagacttgtcttagggagggggggaaaaaacaacaaaaaaaacagaggctaagaggtaactccgaggatgacagaaaacaccagagtttttaagagatgttagaagccctgggagcactgaacaaaccagaaagctcccgacccttgatccctgagctccacctagcaagtaccgcggcagctaacctgggagaacaccccatccaacagagactgaaattcgcctcccaagagagtaagtggatagttctaagctgtccccaaacatggcctcacaaaggaaaactaaccgttgcgaacggaaacaactgaccggacagaacacagccacaaaacacgagcccgcaccctgagttacaaaaacacttacggctcacctactattcgcaccacagaagcaccaggggaaaacgcgaacacagtcccctactatcacaagttatgcagtcgagttcctcacattgggggaaaatggcaggggtcagtacacccggaacataacggataagcctcgccctgagaaaaccaccttcgtgatcatggtatctcccccgccaagtaagtatgagcttttgcacctccgccccgccacagcctcacacgcttcaccctttacacgcacggtcacttgccccgcgcacgccccccccccaccccccccgcccccagccctcctagccctgacacacagctgggactctcaggtccgaccagcggtcctgaacccgctcccacggcacgggaactccttagtggcgaagcagcagcccctgcgctgcctcatctacatagaaatcgccctatccgtgatgtcaccgacagcgcctttcccagacaccgtctgctcttccgccccaccctccgccgactcagccgatcaaaccgctgccggagctggcggaggaagtgacgtctgtctctttctccttttcctcctgccattgtcctttggggaggtgcgcagagatcccacgtctggtctccccctaagactgtggtacttgatctgtgtcctgcagagaacccttctggcggccaacaggaagcttgtgcacccttcttcagataatgtcttttaatgcgcagacttgaacgtttaggattacaaggaaaaccggttcctttcaaacctgtttatctttgtgatgtagcattccgtttcaagttgaaagccattcaatgtcagagagaaaacatatctatgaaaccagagaggctgctcagatgggttgcaaactagccatccttactggttttaccactagaagtgttacaaagacagttgtccaattttatgaatcttgaagggttttttgttgttgttgttatttcaaatacagtgtaatacaaaaatatgtggcccccgcagagacgattggacactctcaggcatggtgatggagtttgtcatctcttccacggccatctcagaaccttagtgcttacctcatgttagtattttatattctccaaagacacaaaaataatcccaatttgacaaaacaaacaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacatgaaatggaggggtctcccttggagaccataaagtctgtgacatggtggccagttgggtcactggaaaacatggcaaaatattgaaaatgagggattaggtgagaatgtagcaactgaacactaaatgcttgatccaggtgccattcctggatactgacagggagacacattgtccaggtaatactggaaaaatactttctatagtgtaaaccacaaataaaattccaagcccctcaactatttgaatgcacccctcctctcagccagggtcattccaaagttaacctgaaaaactggttcagaccatgatgggaagtaggggtcagatatgcctcattataccctccttcctttggaattcaggcacaactgaccagcacatccgaccaggcccaactgacattacaacagcgatctcaagactttttgtagcaataagacaccaaactccaggctgactctagtgtagcattacatgacagatagcaggccctgaaagaaatgaaaatattttaccctaaaatacattttttatcatattttgaaatgtccctacaaagttgtctcttgtggggaaagtctacatgctatagggaatccctttccaggccttttccctaatctaggcacctttttaagtctgataagaaacatttacaatcaattctctctgaagcctgttacctggaggcttcatctgcatcataagaacaaccccttaacacagagactgccttctatggattccaggtctttagataaactctttcaaccaattgccagtcaaagtatcagaaaataacggctggtaactatgtaattatgcatatatatgagtagaattttgggggtggacacagtggctcatgcctgtaatcccagcactccctcaggaggctggcagattgcctgagtccaggagtttgagaccagcctgggaaacatggtgaaaccccatctctacaaaaaaaaaaaaaaaaaaaaattagccaggcatggtggtgagcacctgtggtcccagctactcaggaggctgaggtgggagggttacttgagcctgggaggtgaaggttgcagtgacccaagcttgcaacactgcacttcagcctggatgacagaggaatgggccttcactagacactgaacctgctggcaacttgatcttggactgaccatcctccataactgtgagcaataaatttttgttgtttataagttactcactctgtggtattttgttatagcagcacaactggattaggacatcaacctgaccttaagaaatcatctcattcagtcttggctctggtgggaaacaaggggcacactcggatgtgtgatttaaagagagttgtgtgttttttttttttttttttttttgagatggagtctcgctctgccgcccaggctggagtgcagtggtgccatctcggctcactgcaagctccgcctcccgggttcacgccattctcctgcctcagcctcccgagtagctgggactacaggcgcccgccaccacacccggttaattttttgtatttttagtagagagcgggtttcaccacgttggccaggatggtctcgatctcttgacctcccaaagtgctgggattacaggcgtgagccaccgcgcccggcctaaagagagttttatgaagagaatatttataaatataatatggacaggatcaaaacaacccaaccaaggactgagaggcgctcagaatctggaatcagcagagaagttgtattgcctctaggactggattgttgtataagtctgttcaggttgccataacaacctggacaggaccgtagttctgtccagtgatcctccccaagacaaccgttctctctagtaactatggttttcctttctcatttcaattgccacctcaattgactgaaatgtgaacaccaactcccgcacttaaacgttgaagccctaacacctactgtgatgatttatgcagctggggcctttgagaggtaatcaggattaaaagaggttatgagagtggtgtcctcatgctgagattaatgccattacaagaagacagacactagaaagcttgcttgtccgccttccccctggtgcacgaagaaatggtcacatgggcacacagtgaatctacagccacttacaggccataggaagagaccttagaaagaaatccgctttgctaccacctttatcttggacttcccaacttccagaagtgtgagaaatacatttctatagtttaagccacttggtgtatggtatcttgttatggcaacctgaacagacttatacaacaattaagttgcctttccactgatggacttagacacaatctctttcccaaaaaagagctatatttagctacttttcttttgcatattgttccatttgcagccacactatttgtcttcccccacaccacttctatcaccaggaatccattttccttgttttctttttaatatcgggagcctctgctcactgcactgcatagtccttggggctttttttaaactttatttttaacaatcatttgagcagaaagtagccaattcagttctttaatttcccattttattcttggtttgaaactgacctgattgtgtcccttttgttatgaccagttacttagaagccatacagcccacaaggtgcccttgggtataaatccaacttcttcattttaatggtgagaaaccaaaagcccacgtttcctgatttctggcccagcactggaactgttttcatggcacgtcaattcatcatacattttaatagtgatattttatatttgcataattttattgcctttgcaatgggctttcacatctatcttctcatgtgtatatagtttagaggccatttttacccactatctcctaatcatatcgaccacagcctcaggaaatgtctgctctattatttcacttgcctgtctgggttcttgggcaacagcatagaatcctgcactgtgttttccctcacgctttctcactctttgcagaacaaatttttgttacatgccttattatcatggtaatattggccttcagtcctgtatagaagcattaaaaatgtgcgtaatgtatatccttttaaaatgttatcctaagaagcatcttttggagttaaggagagttagatgaataaagaaagaatacagtttctcctaaacaaacccactaagaaaatcatggaaagaattatgacaactatgaaaatgaaggaggtatactttgtcaacaaaagcaaaataaccaagctactcttagacataatctcacgttatctttctgtagtgctctagcattttctaagcattttcacacactgttatctctttttttctttctccttctagaaattaattatgacttttcctttcaaaaatgaaggacttttttttttttttttactcttttcattttttcctgagaccatatgtcaaagggaatgtgaggaacaactttggtgtggtaatagccaaattcctccaggtctgctcctcaagcttgcaaagtcaagactggcagaagtggtgatttttacctgggtatcctgagaaacttgcacagtccttatcacatgcaggtgttcagagtgtgcaaataaacgaagaaatgtgagattgtgatgatattttcatggcatgctttttttccacacttcctcatgcagcccaacatcctctacactgtgttgttctacccgtttaagtgatttaccacttctccattaagccaacttaaaccatgttgccttcaactcaacattgattgatcccctatacagtcctgtagggaggcaagaaaacttacaaacgaagtggtaaagaaagagagagattaagcaatttgccccaaatctcataaccactaggtgataagtcttcaactagaactcaaatatctgactgagaattcagtgcttttttcatttaaatcacattgcttcataaaaatagatctgcaggaagaataaaaatgtccaaagtgcaatgagacagagaagataatatggagacagacatattgcacagaaagcatttgaccatatgtctgcctgatccccttcatgtgtcttgttcataacttactttactcgggcagcaggagatagcataacaactgtcagagtgaatttaggccacagttttgtgttgctgaatgtgttgagtcatttcccttagttcacatttctacctaactttatcttttaagtcatcatcatggctttaatctcttatttattttgactgttgagattttgtagccattatccaaataaaacatttattttcactcgtgagtccctaatccttcgtcaatggaattagctatttatttgatgcaatagctagaccagtagggttaaaaatgcttttataaagacattaatagctgggtatggtgatgtgcacctagggaggctatggcaggaagatcacttgagtccatgagtttgaggccaatgccttcgcaacatagtgagaccctgtctttaaagtaaaaatttaaaaattaaaagaaaagacatttaaaaaggctgtttaccaaaatgatggttaattgacagaaaatagaaacggaaactagaaatcattgccatcagctttctctaatgtgtacttgatccttttctccctgtgatggaagtcgaaagtctttttgtttttttcttaatccactactgttcaaatgagaataaacagccaaatgactgaattagttggtagacataattcctagtcttcaattatttttatattcttttgtaatacagtcattattttttcagacttctataatattgcatttaaccaatccccaaatagggaaacgttatgtaatttttctattatttacagttccttgattataatcttttatttgaaaagattatatatttatataaaaacccagtttctttcttacatataaatattattagtagtctaaaaatgtcactctcaataaacaggatgagtcaacttgaggactagagaatcaggtagtcaacatcagagaactggtttagcaaacagaaggggcctacccagatagagagaagtcaggcagggctgtgctgtgaaaatattagagaagcttgatgggaggcctaatatagtttgtctttacacctgtatattttgcttcttgcatctgcttcaatgccctctgtcatttattataactagatatattgttctaatagatttgtactacagtcagaacaaacaaatcactggatccagcagaagccttagatatatgacataacagagatttgcacaaagatttgccccattgccttctcaaatttctcttatcatcaatccatctagctggagctctctgaaggtcatcagaggtcagtataattttaataagattttaactgaaggctagccttgatgttcagtgaccttcagacatgtttataatcgagaagccactccccctgttgaatgataacctcttccatgaattaccaaaccaatggtgctcacattctgattaacgattgattcccataaacccagcttcccccaacactgatgatctaaataacctgaattatttgcattgccttatcaattccatctcatttcctgtcttggtggttttgctcacactgcttctatgtggaatgtccgtatgtagccacttgagtttccacttcatcgttccatcatctgtagtctctatacactatccatcatcaggactaatgtgagctgactttcctccaaaaagctttccctgaacttatcctgaaataacgtttttctctgctaacttagcatttgtcacgttagtatacagcttctctaactgtcatgaaatgaaataaatgggaagaagatgaaacatgaaaagaaatctgctccttaaggcaggccctgggggaatagccctggctggaggtaatgtaaggtctagatggtgtttttagaatctgaagactgcaacaccaaacacaacaagtataagcctaggcaagctgtcagtgcagggcctaaaattaggtatttcaacaagtggatgaatcaatttggggaattgtattagtaaacagaggaagcccgtccagtaaaagggagagtaagcagggatgcaatttaaaactattgaggaaaaatggctaagaaatagtaaaattaacacatggcctaaaatattaagaaattatgcctgttacagaattacggacctggctagtatataggagcattaacaacacaaaaacagattaggtcgggattagcagtgggggtgaaataatcttcagggctgaactactgagctagaaatatttaaatcctccttgcagatgaaaactatagaggacaatttattggttcagcatgaatttctggtcttctgttaagaaatacgctctttcattgaaagtgaacattgaggcagtaaactccaaatacagctgcaggtactatctcctgctgatttgtgtgtatagagcatgaaagaaaggctcagaaacaaaagcatgttggaaaaataagcagaaggagacatttacttgcaaagaaatgtgaggaagtcattcttcaaaagaactgcccaaaaaattaaaaaaatagaactttttaagacaaacaatattatgaagacaatagggcttatattaatctcttcatggcagaaaacagcaattttatcatggttattgtattcagaaagttcatgacatatcttcagacaataaacagcattgtaaagtcaaggataaagtgattttcattaaggagttagcaactctcaggaaatgctcaaggttttattcatttggaggactgcaggtagacagagagacccttttattgtttctttatgtcagagtgcagagtttttttttctctgtttcttcagcagtgggacatgatgaacgggccgacaatggtgtcaggccccgatgtcactttggtttttacacttcatcttgcggtcatgtttccttctctacaggacatgtttgtctacctccatttgctgaacaatgttcctaatcagtactattgattttacattttaatttgatccattttatttgcacagatctaagaagtgttgattaatatttaatgacctcctagtatttttttgatgaaacaataaactaaggctcacaagtttacgtctatctatagatttataaagcccttgtgctttaaatttacttttacatgtttaacagctcagtttagagcagaccaaaccagtccgttcacctctacctgatttcatctgcagtatttataatgcaaatgtatcctttttaataaaagttatccaatgtctcggtgtccctgctctgccaagaaaggacattctttcttacctccaagcctgagattgcatagtccatagagcaagcaccagattggtttcctagaaggatgttataggcatcgcttctgcgtgaaaaacatagaaattattcttattactggatttgtcttgtctaattaaattgaatttgtagcacagctataaattttttattaaaaaattgattcttcctggctgggcaaggtggctgatgcctgtaatcccagcattttgaaaggctgaggccggcagatcacctgaggtcaggagtttaagaccagccaggccaacatggtgaaaccccgtctctataaaaacacaaatagtagcctagcatgatggtgggtgcctgtaatcccagctacctgggaggctgaggtgggagaagtgcttgagcccaagattgagaggttgcagtgagttgagatcacgccattgcactccagcctgggcaacagagcaagactccatctcaaaaaaaaaaaaaaaaaaaatttctaatcagtaatatattcaggtagaagggaggacaaattcttattgaaccaatacaaataactacatagtcacataaagtaaatgtttttattaaagaaactttgtgcaagatttaagcaatattgctaattaagtgtatgttaatagacaaaaccaaatattgtatgtcacaattctttacaaaataattatttgtatgtttttcttggcaacttattagctttgtttttatattaagaatttctgcaaggtatttttttcctcaacactaagaattcagagtgttttatttagtttttacaaatttaataatttgtacatttaattggagattaaaggtagattaagaagaaagaaaatgggtttctctcatgttcattaaagtagaaaattaaactagcctcaattaaattgccttactgaggccctttaatcctaaataacaacctcttgtcgtgctggtcttgagttaagcagtctactttcatgaattcatcggcttctacactgtgagtgtcttggaactcctgactcatttacttcgtatagttggaatattgtctgtggggacaaggtcagcctattcttggaggcctatatccatgagtcaatttcctgtggtatcaatagtatcaacagtgtctgctaccgttattactggagctcttttgatacttcttccagatgactcaaattctgattggcgctttgtagagaggcttttaggtatgcttaaagggaaaggagggctaggcacagtggctcatgtctgtaatcccaacactttaggaggctgaggcaggcagatcacttgaggtccggagtttgagaccagcctggccaacatggtgaaaccctgtgtctactgaaaatagaaaaattagccatgcatggtggcgggcacctgaatatagctactcgggaggctgaggtaggaggacagcttgaacctgagaggtagagtttgcagtgagctgaggtcataccactgcactccagcctgggcaacagagcgagattccatctaaaaaaaaaaaaaaaaaaagcagcggggatagggggaggagatgttgctaataataaaactgtaaagtttggttaattttttgccatagcaaacaacatcacaatgggggacagtggcattctctgttgaggtgtaatacatactcatctaatgaaattttaatcagtgattaccgtaaaagacagaacacatgaagaacaattagtgcatcccgatacctctccagggcctttaattttccccacaaagtagatattattatttgtcaccaactgataagtttactttttttaatcagttggttgacatttattgcaccagtctttgtacatgaacataaatatgcctgaatccaacctgagaagtgcacaattattgtaacatagccacagtaatcatacataattattgcatttaattaatttaagatgattttattgctattttctcagaatatggccttgaaaaacacagcagcttccactatattgagcatagttttgagcaaattaaatatctggagaatgcaaaacattacctttatttctaatatatcttcatgttaagagctaggaggaggatctctggagtttcccagcagccatctgagaaacccagagatactgtattcataagtaacatctcagtagttttactattttggatttgagggttaaatttggggaatatggtatcaaaaacagtgtcacaggtgggggctgcagatgtgaagggcctgctatcaatcaggtgaccctggatggactacccactccctgtgtcagtccaggatcccagctgtagtgggttcctctctgctacagcacatgtttctaaagggcaagaatctgggctcccaataactgacctctgtctcctccatcctggcttgtcatggtagacccgaaccaccctcccattgaatttgggcccttgtggctcatagccacaagggaaattgggagctcacatgtgaaaggcagaattaagttaatgcaccttcttccaaagtcttacgtttgtttgtagcccaggtgcccctgtttccagcaggagtattagcagtaccaggcagccactccccagagtttgtgtttctgagctttcccatcatcagttaattggaaatttcaggaactgtccctgccttacaatgcctgctctgatctacaggtcttttggagacagacagcaggtgatggggcatgccaaagagataaaaatgtcttctgataatcaggggtcagcagatgagtatgaaagctaattatccccactactcagggaatttagaggcttccccttttgtctttgtaggaatagcagactttctgactgtaatgtccaaagttctttacaagttgaagtacagaagagatcagaaaatgtcttacgcacatgagagttgttatccaaagatttgtcataggagcagcgactctaggtgttctctattctatttagaagaattacattagattttgattcctcaatgtggccaagaaatagagctacttgctgggaacaagaaagacaacatgacttctggaaactatttattatgaaaaatgaattttcattatgtagcaaattacactgcagaagtattacaaagaattctcatagacatggtatattaaatctcaaatcaataatcatacatagtcaattaaaaatatctttgttgatatctttcagaacctgggaaataattttctgactttcaaattttttagtttctattcagtggcagaaaatctgtattgtgccaaaccagtctgaaaattagtagttgattatatgctggacacagaaaaattttctataacctgttaaatgcaacactccattcattgcttaattctccccaaatagcataaggtaattaaggcttttgtaaacttttttctttttttagaacagcctacagtgacagaggagaatggttatattgttaattaaagctggttcatcactcatgtggtaaacctgactcacatggaaacttaactattttatcacaaagataaatgtttatcatttaaatatgtatgtattcacttttatacttcttgaaaggatttctaggagtacaaagtaaactactataaatctcttttctcccggatggcaatattgttgtgggtgagaaacaatttagtccaggagagctatatctaatccggtaggacactgtggagaatacaagtgttaaatttttgctaaaaaactaatatatggccgggagtggtggctcacgcctgtaatcccaacacttcgggaggccgaggagggtggatcacctgaggtcaggggttcgagaccagcctggccaacatggtgaaatcccatttctactaaaaatacaaaaattagccaggcatggtggcaggcacctgtaatcccagctactcaggaggctgaggcaggagaatcactggaacccaggaggcagaggctgcagtgagccaagatggcgccattgcactccagcctgagggacaagagcaagactttgtctcaaaaaaaaaaaaaaggctaatatatggagattgatttatcattttatcaaaaaggtaacccaaacactaatatgacttttttgagaccatccatttaacaaattggactaaaagactcaaaagttcttttatgttttatgcccaaactaattaacattgagtaaagttagtccaaaaattataaacgttttattgctcatttaaactcattatttgcagctattataagctatagcaaatgaagtttacttccctcagatattctacaattattgtatgcccttaaatttgtattttaaaattcagttttatattctagcaaaactctacaatttgccttttagacaaaattactctctttgccttgataagcaaaaacacattaattatattgcatgcacttttctaaatactcaaactgacttaatttcttaaagtagtataaaagaacatgtgcattaatcagaactaagggtacttttacatactgttcattctcctacttgatagccactctataatgtgtaaaaatatgcagcaaggatatgttaaaaattttatgagactcatccaaagatttttcactaattatctcaatgaaatattagccaagctcataaagctaactagtatgttaaaattcattttaaactgacacactgcagagaatttatactaaaatataaaaatttacatgaaaattgtgttacatatgaaatttgaattttttaccatgtagggtatgtgtggttttacctatacagtataattatttgtagccccatctcaagttacaggaacaaatgttttaaaaaatactagtttaataattcaattcagctgagccataaatccagtaggggacatctagaaagctctggtaagttaaaatattttataaaccagaaaaatatgctaacattaattctaagattgtgataaaatcagagaaaaaacataattaatttaaaccaaaattatcaaaccatatacatttatccaaggatttcccatgattaaaaatattactgaactttacttcagtcaaatttttaaaacgcttcaattttgttctgaagcactgaagtcctttgcgttatgcgattctcttacccgcctgccttcccttgcttctcgccttctgacatagcaacaaagtccattaattcacctcagaactaaacctctctatagattttttcttctgagctgcagttcagcaagttacctgtgctagtatacataagccaaggaaaacagaagctccattaaacttaagaaattgtttaacctaattcattaattttctccagagataggaaaatgtacaataatttgttcagaagatatttacatacatacaacaagaagtcattatgaaattcggagccagtgatgattttctccctgctttattgtagactttcatatgctatttatttatagtccttatccagtcagattatagattatggtagagacgtaatttttgaggttgagtaatactttactgttgatgtatagaatattcctcacaacttattttaactcatttttatatttctatgagattttccttgtttggggttttttgtttgtttgagaaaagggctagagaaatttaaatgcttgaaaacctttagagttttcagaagcacccagaacttcaaagaaacacaaagctattctcattaatgctttcttaagacaaataaagcaaagccctatcaacagttagagctctccatttttcaagctatgcaagattgtctccaatagttatggcttcagcagtggttcagcttgagtgtgcatcagaaccacctgcaaagcctaattaaacggattccttggctcacttggcagtatatgactcagtaggtaagatttgagaatttgcatatctaacaagttgtcgggtaatactgataccgatgtctagggactatgagaatcactaacctagagtgtttaaaaaatgaccaatttctgtgcccaattatctgccaaagtttcctaagagaaggaaaacaacaacaacaaacaaacaaacaaaccaaaacagagagaaactgagagaaacagccacaactggaaactagtaacacaaaaacaaaccattgtaaaggctaattaacttattttcataccaatggggaaagatttttatttcattttgcactcacaaaaagctttaggagttttttcatgtgccagaaggaagcacataacctccaaattcacaatctattctttgcccgtttgctgtagttactctttgtaccaaaggttctgagtctggagtctctgcttccactggtcagatagactctctccttacattgtggtctctcactgaatgttctcacccactgcttcctcactacgtaatatctgcccaagaagctccccgtcttctcattctcccatcccatatgctgacattctttccagtccctgcattgttatgagagctcagtgggggagggagctgaatgtctgtattcagtccacaactacgatctaggatactctgtattaaccataaataattgatgcaagtttcttccactcagccatagctgagccagattacccgcaatgctatctcatcccaccacagtctctacgactaatttctattatacaaggtaagatcaacatttgaagtgattgagtttaaacataaaaagatgtattggctcctgcgactgggcagtcttcagggttagttgcttgagtgatcaacgataccattaagattatgattgggacatgaaaaaaagaactggcaaataaggagagaactttgacaatagaaaggcatttaatccttgtgttgttttgagcgccctaaaggaaaagacaaattaaaggcagatcctaacagaactattaacaaagaaggaagagggtgaatgagactcttgaatcaaaaattcttaattcttaactccacctgtgaaatcttacttaatctggttatactgagaataatcatcacaccattctgtctcacattctagaaggctttgtagtggtagaactgtaaacaacatataaacatttctgaaatattgtggttgttttatcttccataaacctcacacaagccgtgtgtatgatcatccatcttctgggccattatctgattattgctgctatctctcgctttggggaaaggaggtccctttccttatcaatactattggatcagctcttctaatttcatgatgacatgagtgttcaggaatgatggaaggcaaatgtaactctgagaaaacttggtttaactactgcatttcacaagtccatatccatcctagaaggtcttccagcctgctctctgccttgctcccaagatggccacatgtaggtctcttctttcccgtaaccagagggttatagattatattatccttcaaagtctgggataaaccaatttctcactctaaagagaacaacgtgttttgatttttccaaccctaaccctagcctaaagtctaccttctaatcctatcttattacaaatgtccctggattgatctttcaagggatttttgcctactgaaaaaatattactctcactcaaagaattgtggcctgacaagaaatctacaagagtcttggacacagaggccaaaacatcataacatctggattattcaggataaagtaatatcacctgtgggttacccacagcccagtcctcagcttcagacaatgccggagtcactagtgttctgttttctttcctctatcattcctattcaaaaattctaaaaatttggagttccatttctcttaagaagacatgaatacattagtacagtaacatatttatttctacttccttgaaattttattgagaaatccatcattttccaaacttttctttctattggtgtaaaacagggatgaatggccatgagcacttcattgcctcatctcaggtgacacttctttgccctttgaaaagcctataatgtactttataatgtagtttaacttttccacttcacctcatgtaaacaaactgattttccaacttatcaatacagtatgaacatttctccaagtcaattaacaaaaagaggaaatatcactttaaatgaatgcacagtttctctatatagagaaaaataatatgtgtgcatatatgcatgtgtaaatatatgtatatgactaaattctacaagtttttaaactatctttttactgatggagactcatcatggtttttttccccctgtactacaaacaaagtagccataaacattctaacattctggagtatggtatcccttatatgaaatgcttgggaccaaaaatattgtagattttggattttttcaaattttgaaatattttcatatcataacatgatatgttaggaatgagacccaatctaaatttatttacattccctacatatagtatacatgtagcctgaaggtaattttatgtatttgtaaaattttgtgcaagaaacaaaattttgactgtcttttggctgtgaccagtcatataatgtcatatgtgaaatttttcacctgtggcatcatatcagtgctcaaaatgtttccaattttgaagcatttcagatttcagattttttagttgaccttggaacaacatgggtttcaactgtgcaggtccgcctacactggtattttttttaaaaaaaaaatatatcagaaaaagttttggagaattgcaattgaaaaaactagcagactaactgcatagcctagaatataaaaaaaaaaattaagaaaaagctatgtacatcctgaatgcataaagtatatgtatatattaatctattttatcatttactaccataaaatatacacaaatctattataaaaagttaaaacttatcaaaatgtatgcacacaaaccgtacaagtcactatttgcagtcaagagaaacataaacaaacataaagatgctgtattaaaccacaactgcatacaattaacaatagcacatactgtactacccaaataattacttttattttatttttataaatgtgctaggtacaagcatacttttattatatgattgttttgttatttggatatattgctagtggtgaagtctgaggttttactgtactcatcaccccaatagtgaacattgtacccaataatcatttttcaaccctcactcccctccaaccctggcatcttttggaatattctccagcgtctactttccagtgtatgtactattataataattttgtagccaccccctgttgctactgtggtgagctcatgttgccagtatctgccatgagcacttggtctcttcagtaaattctgtatctaagtaaatagtgtgttctctcacagttctcttttcattgtgcttagtgtaatactataaatcttgaataacaccatgagaccaatacaaagtgccacaagtgatgctgggagtgctcccaagaagcagagaaaagttgtgacattatgagaaaaagttagattgcttcctatagattgagttcttcagctgcctgccatttcaaaataaatgaatccagtgtaaggtcccttaaaaaaaaaaagagaaattcataaggcctcatttcatgccaacaggcatgaaaaccttgtcctttcttatctcatattcaaaatgcagcttttatgtggggtacagaattgctataagaaagacatacctatagactcttatttgattcaagaaatagcgaagtcattatttgacaacttaaagtaaaagcaaggtgaaagatctaaagctggagaatttaatgacagcaaaggatgatttgataattttagaaagtggtttggttttaaaaatgtcaggataatgggagtagcaacttctgccaaccaagaaccagcaagtgaattctcaaatgccgttaagaaaaacattgaggagaaaggatatctgcctgaataggtattaatgcagctgaaagtgccctattccaggcagaaaaataaaagccacaaaggtcatttattagtaaggaagagaagcaagcaccaagatttaaggcaggaagggataggctaactctactgctttgtgcaaatgtagtcgggtttatgatcagggctgcccttaactataaagctgctaacccctgagtcttgaaagggaaaagagaaacactagttgccagtcttttggttgtacaacaagaaggcctggactatgagaatgctttttctggattagttccatcagtgctttgtccctgaagtcagaagtaccttgccagtaagggactgctttttaaagttttttgttgttgttgtttaattggaaaatgccccctggccacccagaaccccatgagttcaacaccaaaggcactgaagtgttctccttttcccccaaacacatctctacctcagcctctagataagggagtcataaggacctttaaggctctacatatggcactctatggaaaggtttgtcaacattgcaaaagagaaacccaatagagagaacatcatggaagtctggaaggcttacacctttcaagatgtcatcagttgatatagaaaaccatgaaactcaaaacaataaattcctgctggacaaaagtacaatttgtgtccagatgttgtgcatagctacagaattacgacaaacccaatttagagaaaaccatggaaagaagtatggatatgaagggaaaaaaaggtgtggagtgaagggttgcaagatatggatcttggaggaatttaagaactaatacacaccacaccagaggaattaacaaaagatgacttcatggagatgagtgcttcctaaccagtgccagataatgaggaagaagacataggaacagcagtgccagaaaacaaattggcattcaacaatctggcaaaagaactttgattattcaagactacttttgacttcttttatgacatagaccgttccatgatacaggaactgaaactgaagcaaatggtggaagacggataggtactacactgaaatgtttttagagaaatgaaaaagcaaaatagacagaaataatgatgtatttttgtaaagtttcaccaagtgtgcttgcctcttttgcttccccttccatcccttcaccctcttccacctctgctaccctaagacacaaagaccagctcctcctcctcctcctctgcctactcaacatgaacacaacaatgatgaagacctttaggatgatccacttccacttaatgaatgggtcatatattttctcttccttacaattttcttgactataatttcttttctgtagcttagtttattgtaagaatacagtatataatacacatagcatgcaaaatatgtcttaaatgtaacgcatgttatcagtaagccttctggtcaacaataggttattagtagtttggggggaatcaaaatttgtatgcagatttttcactgtgtgggaggccagctcccctaaccctatattgttcaaggggcaacaatattctttctcactggcactttactttccataaattcaaatcccaaaagtagaactgcaagttcaaaaggatttttaaaaaaataattactgtcagattacagaaagtttccaatttacattttcactaccaatgtacaatgttggcatccctgaatccttatcagcaatgaatttttaaatatactataagagatgaaaaaatttttttaaaatttggaattccctgatcactaatgaagttaagcatcaatattattcctttaatatgcaaatgctgaaaatacatttaactataatagatgtcaaaaatctgtaaatcaggctaggtgtggtaggcactcacctgtattcccagccactgggagacttgagtccaggagttccagactgtagtatgcaatgatcaagcctgtgaatagccactgcactccagcatggacaacatagcaagaccccatctttttttaaagaaaagagtctataagacaaaggtcctcataaattaagagaagccaagacagtcactgtgactgcagaatattttaatttttttttattatactttaagttctagggtacatgtgaacaacgtgcaggtttgttacatatgtatacatgtgccatgttggtgtgctgcacccattaactcatcttttacattaggtatatctcctaatgctatccctcccccagccccccaccacagagcaggccccagtgtgtgatgttccctttcctgtatccatgtgttctcattgttcaattcccacctgtgagtgagaacatgcggtgtttggttttttgtccttgtgatagtttgctgagaatgatggtttccagcttcatccatgtccctacaaaggacatgaactcatccttttttatggctgcatagtattccatggtgtatatgtgccacattttcttaatccagtctatcactgatggacatttgggttggttccaagtctttgctattgtgaatagtgccgcaataaacatacgtgtgcgtgtgtctttatagcagcatgatttataatcctttgggtatatacccagtaatgggatggctaggtcaaatggtatttctagttctagatccttgaggaatcaccacactgtcttccacaatgatttaaccagtttacagtcccaccaacagtgtgaaagtgttcctatttctccacatcctctccagcacctgttgtttcctgactttttaatgatcgccattctaactggtgtgagatggtatctcattgtggttttgatttgcgtttctctgacggccagtgatgattgatgatgagcattttttcatgtgtctgttggctgcataaatgtcttcttttgagaagtgtctgttcatatacttcacccacttgttgttggggttgtttgttttttcttgtaaatttgtttgagttcattgtagattctggatattagccctttgtcagatgagtagattgcaaaaatgttctcccattctgtaggctgcctgttcatgctgatggcagtttcttttgctgtgtaggagctctttagtttaattagatcccatttgtcaattttggcttttattgccattgctttcagtgttttagacatgaagtccttgccatgcctgtgtcctgaatggtattgcctaggttttcttctagggtttttatggttttaggtctaacatgtaagtctttaatccatcttgaattaatttttgtataaggtgtaaggaagggacccagtttcagctttctacatatggctagccagttttcccagcaccatttattaaacagggaatcctttccccatttcttgcttttgtcaggtttgtcaaagatcagatggttgtagatgtgtggtgttatttctgagggctctgttctgttccattggtctatatctctgttttggtacaagtaccatgctgttttggttattgtagcctcatagtctagtttgaagtcaggtagcgtgatgcctccagctttgttctttttgcttaggattgacttggcaatgcgggctcttttttgtttccgtgtgaactttaaagtagtttttttccaattctgtaaagaaagtcattggtagcttgatgtggatggcattgaatctataaattaccttgggcagtatggccattttcacgatattgattcttcctatccatgagcatggaatgttcttccatttgtttgtgtcctcttttatttccttgagcagtggtttgtagttctccttgaataggtccttcacatcccttgtaagttgggttcctaggtattatttcaaatattattgtaaaacaatgagatattgaaacatacattggagcaaactcttcttcatttttaaatcctttcagcacagagacaatcaactgactgtctgggtactacctgaccactattggagtctctttcatctgcctgagtctgtgcaacaatatgaaattataattttactatgcacctaaacgttcctcaatatattgaattcttacagaatttgaagagtcaaattttgtaaatccagttacctttttccactactctaggcctcatatactatctggcctaagggttaaaggtccacaattgaataagccaaacttgttaatttgaaggtaaagcatgtcaagaaatctggccttaatgtccaatgaacttatgtcatattaagtagctggatagaaacatgcattccaaagtggatactgtttatcaggctcagtgtgctctattcttgacggtaaatcccagaatagggtggatgctttaattttgtattaaatagtattaggtgtaatatcaaaaccactaagggaacactaatgatgagaataggaacactagctgtggagctggcaactttctatagaaatcctatctctttcaattgcctgtttagtgggcaagtgtttcagttcctataatatctaaattggagaaaatcaccccacctacttcttcaggtgttatgataattatgagggataacatctttttaagtgtttaacacaattcctcacacatagaaagcaataataaacattggctagcattgtaaggatggattattgtcttccaatgtgttttcatacattttctttctgggatcttgagtgaaacatgtggatctagaacaagaacaaaatgatgttaccttgatgatctctatgtagggtcacactcaaggcatcttaaaatattttgctggccaacaaaagacacctcctgttctaattgggcattgtccttttctttaaactatgcagacaaacaatattataaagtgagaacatccgcataaaaaacctaaacataaatcttaatagtgagttcatgaaaattcttactgatgaaatggcaatgtcacagactgactgtttatgtccccccaaatttgtatattgaaatcctaacccccaagctactcgtgttaggagatagagccttggggaggtgattaggtcatgaggacaagattctcatgaatggaatttgtgcccttataaaagagatcccagagagctcattggccccttccaaagtatggggatacagcaggaagttgccatctatgagccagaagggtgaacctcaccccagatgctgaatctgccttgatattggacttcccagcctgcacaactgtaagaaatttctgttgtttataagttactcagcttgtggtattttgttacagcagcctacacagactaagacaagtagcattttgaggattaaaatttcttcataaatgaatagagtatgccctgttaaaccatattctcagctaaccccgtttactcactgttcctctttattttagtttcacatttttgctatttatctctgtaattttattcattcttcacaatttgccattcttatacttcgaatcatgttatcagtttataatacctccatcaaatgatagtctgcatttgtttatccttggctgattcaaaacacttggcataatttccttaaaggaaatcatcttcatcccacctcacaacactgtattattttcaattaatttccaataaactcttaattgtccatgctctgtcagagttggcagagttaatccctgtttaagctaataggttcaacttcttcaacaaacaaatctttcatgaaagctgctgacaagccagagtattaattaaatctagtttcattgcttctcactttccttgatccttctctcttgttctttgggaaacagtcacagagttctggcgctaataaatactataaaaagtaggaaatacagtctaaagaagcagaatattctgtttaaagttgatgtggtgctttttgtgcaccaagcattggctcaaaagcctgaaaattaggcagcaatacttcctaagctcatcttcaaccataaggcagaaaagccaaacatatctgaaaatataatatcactggtaccttataccagcactaagaataagaaaaccctggaaagtggctcgagtacagtatttttctattggaattaatttttcaaaatggaaaggacttcattgttatttttattataaaattagtatatgtttattattaaaaataagtacaaaaatctctaaaagaaaaagggaaaaattaccagcagttccacattccagatatcatcactgttagcatttaggatacaaatatccaaacactttttctatcaatacatttaatttttaaatttgaccattacgcaatgtacacatgcactaaagcaccacactgtaccccataaacatgtgcaattattatgtcaattaaaaacaaaataaaagcattttacaaaaaatcatgttatttttaataacttgtttttctaattttatacaccataaaataaatgtctttacatgacatttattttatgataataactaatttattcatttaaacagcaaggtacatttcattctacagatatactatataatatttactccgatctctggatgagaatttatgttgcctgtaaatattgtatcacaaacattataagaataatctctgtaaaggttttcttcctgaattattatttgggtagaaaaattactagaaatagaataactgggtcaaagattaaagacaatttaaatttcaatatatagaatcaaattattctccaaaatattgtactctacagtatttgaattttgatttttttctccattttcactactgccaataactttaatctttgtcgataaatgagacaaaaaagacaaataatgcaatattatacaagggagattaataggtagaaaaagaaatgcaatggccaggagtaacagaagatgttcaacatcaatccaatcaaattaatgcgtctttaaaatgcaatagcagtcaatgttagcaagagtgtaggtattagacattctcataggaatataaactaaggccatgttttaggatcatattagatcgcagcaattaaaaaatgttaaattcatatgttgtatagcaacttctcaggttggaatttatcacatggagaatcttgtaaaatacataaaccaagatatgttattaatgttattggtagcctattgttttaataaaaaatatatttatacaatacagttgttaaaagttaagaatatcttgaaggtaaattattaaacaaaaatagaaagcctaggccaggcaagacttcatctcatgcttataatcccaacacttttggagactgaggcgggaggattgcttgagcccaggagtttgagaccaacctgggcaacacagtgagacctcatctctagaaaaaaaaaaatacaaagcctagttctgaacatccttttgtgtaatactaaaagataaaattttattttctatcttgtttaagatctatattctatacgggggatgtgtattaaggtcatttttaaaaagatactcaagaaattgtcaacagtgattatcttaaggagagattctagatgtctgggggtaagagactagaggaaagagaattttatatttcatttttacctttatttaattttttgattttcttactgggtgcatgaattatatttttatgtcagcatgttttatcagataaataaaattatgagctatttctgttttctctcatttgttttatgtttaaataaaggaaaatgagatatgtctttttaaattagataatcttgagtccatgattattatgaaagccctctgttatctttttccttcctttcacaatgactatttatgttgtagaatcattaatttctcaagacaaatgtcttagaaggtagatacaaaaaaaggtatacattttttgattcaagctaatttcatgttatgaacaaaattacgtaatgtcatttctaagacctttctgtgatctatcaatccactaggttaaagagcagaaatcacttccaaaacaaatccttttgcagtcagcaaaatgaagcaattatatgaataagtttttccacttggcctatttttctacccatggttattaatcagtctcactgactacattttctgttttacatcccctttcaggcactactgcagatggccaagcatatcacattatgtaaataaaataaaacaaaatcttttcccattgagcaaatggatatacttcacctctaatgcttccagtctttctcagatcattcaaaaagcatgatatggtttccatgaaaggacattcatcccatttgactaactggaatttctttactccagctaatctttaccaaagagctgaattaattcaagttgacaccctgttatctaccagctcttccagcccttttgcttgattgttttgtcattttgccttttcttttcttctaaagtgggagtatggagatttacccttctgaaacagctgtgtcacatcatgatccttgagaatatcagctcttaactggctgcacatcaaaatcactgtttcctttgaccaatactctagacacactcaagcagagattctggattctgatttaattgacacagagtagggcctgggcatttttacagctccccacatgattctattgtgcctcatctatcctagcccttaagcaggaccaaacatttgttctatcttaattattattctcttaaacttagtccaattccttacaactgatagctttctatatactcatctgccttgagtgatgacaattgatatggtttggctgtgtccacacccaatctcatcttgtagctcccataattcccacatgttgtgggaggggcccagtgggagataactgaatcatgaggatgggtctttcctgtgctgttcttgggttagtgagtaagtctcatgagatctgatcatttttaaaatgggagtttccctgcacaagctgtctctttgcctgctgccatccatgtaagatgtgacttgctcctctttgtcctccaccatgattgtgaggcctccccacccatgtggaactgtaagtccattaaacctctttcttttgtaaattgcccggtctcaggtatgtctttatcagcagcatgaaaacagatgaatacaacaatactgtaacaaatcgactcacatctgttctctttataggaattgcagtgctacaatattagtggctcttaattctaagagtgttaaaaaatattaatgcttgtctcacccctaaagtctagggtgtgacctgagtattaggttatttaaaacttttctcaggtaatagacatgtgcagccaaggttgagaaccactctatagggccaagatatgtaagaaaattcaagtcctttagctgggcatggtggcacacagctgtagccccaggtactctggaagctgaggtgggaggattgcttgagcccaggagagagaggctgcattaagctatgatcacatcactgcactctagcctgggtgacaaagtgagatcatgtcaaaaaaaaaaaagaaaaagaaaggagaaagaaaggaagaagaggaaggaaggaaggaaggaaggaaaagaagaaagaaagaagaaagaaaggaacaaagaaagaaagaaagaagagaaaaagagagagaggaagaaagaaagagagaaagaaagaaaagaaaaaggaaggaaagaaaggaagaaagaaagaaaaagagagaaagaagaaagaagaaaaggaaagaaagaaagagagagagaaagaaggaaaagaacgaaaattcaagtcctgccttgtaaaatgcagtactccattttcccaaagagatcccaagggaaacttaactacaggataaagacagacaaaaggacataaattacaactactctaggttcacatattattttgtttctgaaatgggttttaaaatatctatgtcagagttcatttctagaactttatctctagaaaacatattttcacttctcaatacaggaaaatggagattggaaaaatgagtttggaaaatgatttccatgcttatctctcagcttcttttttcaacttccctttttcatctccgtatcttcactgatacctaggaatctctgttacatcacagtcttcaagagctttgctcacagcgaattagttaagacattagctttcaaaagtatatgatattctctcacaagcatttgtctacttttaatagggcaagctacgtaaagatgttaaatctcattccagaaataccacatctattctacctatttatgagaacagtcgtctctagaccaagatagaaattcatagttaggaaataaatccctgtagggtttttccacagtcccaatatgtcccctactgtcccgattttagcaacaaaaatcccccatccagaaaatccttcattcctgagtaagttgaaagattggtcaccctatttctatctgtgtctctttctttcataattggctcataatcatagcagtcacaattttgaaaaatgttattttactgaattactcattgctgttttctcattttttaaataataaacacttattaagaaacattggaaatataccaaaaatagtaaacaataaaacagaaaccattggcagaaatagtcactattaaaatcttaatatactcccttccaatgttgtttctgttaatgcaaattaaaaaatcagagattcgcctctgtgaactagatctctttttacctttagatattatttgacaaatacatagctcaatcatctatccaaacttctcttttacagactccatgccaattaaccttctcctatgaaactattatttcttcacataggataaatatggttattgacacacaaactttcttagttacactgcaatccagttgtgcgttcctaaatttataccaattggatttagaatgatcattactaaagaggcttggccttatctcttgcaatttgcttcttccttcttaaattcaattcttgtaatgtaactataatttgggggtatctttttgcctcatattcaaattctctttcaaactgaggtacatttctgtatttctgtatttgtatattgcatataatagtatagaaaacaataatgagattatagtgtacataaaagttttgaagtataattaaatatttaatatataaatatattaaatatgggctgctgactcaccaagcctggtttggcttccatcacttgtgtaatcaatcacctgtattaaatcacctctgcttgaaagatgaagaatagtttctgatttataagcaaacactgaaagctcttctatttcttgtttgctaaacaagatttgtcaaagttaaatattttattttattgaattcactttttgcctctcctacaatgatgatttgcttttcctcctttaacttgttaatgtgatgaattatacatagtttttttttctattgttagaaatccttgcattcatggaacaaacacaattttcatactatattttttatagacttctaaacttaatttgctaacttttaatttaaaatgtttgccgttaggttcatgaggaaagttggcatgtaattttcctgtcttacacatttctcatataacattggtatcaaggttgtactggcctcataaaatgaacgaacaaatggacctttttttattctggagttgtttttataaaatggaaataatccatttcttgaaaacatttgatagaactcaccagtaaaaatgtctgggcctgctggttctcttcttctaagaagaatttggaacttataattaaagctcctttaatgtgttagaaaactttccaggtttccttgaacattaataaattccaatgacgaaaagccctcagatattaaatataaccttaaatataaccttcccccaattcaatttttcttttgcagatatgattagatactctaatttttcaacctctatttcacatatccattttcctttcctcctctgtactgtcttcagcataatttgtttagtctaacttccaactcacttattttctttttggttctatccaatattgtgtttaacctgtccatttagtttttaattttcattatattttttatttctaaaagatctcttaaattcagtttcaatctgcttaatataagatacatacactgtctcaatttatattcctggcacacctcattgattttttaaacatattaaacacagcttttatagttatataatcgtcctaatatctgaaatctttatgggcataattctgtttctgctcatgatgtttatttcctcatgagttttgtaagagtcttacatttttctcattttggatgaaattttacctgtggccattctttgagacatgggctgaatgtgggtttctccaaagacactttgccttcgtcttgtgtttggtggtaataccaacatgggataactataaaataaattatcagtttcatgtgtgggttttttttaacttatacttacagtgaaaatttaaaccacaaattcatgtgaagatggccttctcatttttcctctaaatagcaccgagtttgaggcaggaaaatttcctggttgtctccccctgaggaacaggtttttatctagtttatcctttcactgaaattatagtccttcgtatctctggctttcagcagttttctcctgtaagactgctatactgggcaggcactaggttttgtctcacactctcccatatcccaggtggtcataaaaattgaagctcagggtactagggccaggactgtccttatggaagcttctggtttgggggtctgcatacctctctggatttatgtattctccttatgcttggcctatgtggttcaccttagtttctattcaagtcagtaatatacttttgaaaaatgacatgtacattttatctggtatttgtagatttcatatagcaggatagtgattcagcaaatttagtctaccacaatgctgggaatagaattcccctaatttttgaaaacattatattaaatcatgtttattgccattaatagtcttataaatgtgcttttaactaactgcattttgtcatagctcattgtgattgtatatttaactagttcacccctacctcatgttttttgggagtgaaggttgtactcaactcattatgttaagtaatactacagtaaacatcaatctatacatgcattaataatgatttccaagaaagtagtgacacatggtcataatcatctttgaggctgatggtacatattttcaaattgcatctcagaaataatataccaatctgtgctctaatcagccgcatatgaaagtgtcatctttctgttctccaaccaatacaactactactgtttttatacctgcaaatctgacaaagatgtgagaaggcatcttatagtttcaatttgtatttctttggtgaccaatgtactaaattactcaatgtactaaattactcttttcctgtttatgatccatttcaaacaaaatgtaaaccattttttaaatttttttatattaatgcaaatcgtaaatcactactttatttattcaacttcctaagcaaaattatatgttgtcccatttatacattttatattagatctttctgccttacatttataacctaaaaaatgtcagaattatataataatgatgaacagttgattataaataatgtctttattaggatatttctccataaatctaaatttcatcaatctttctttaaatatctctacacaatgtcctcttgtattatattaataattgcagatacacttctttttgctatttctattctttcctattcctattgtctgttagtctcccattttctcccataaaataaataaaaatttttctatcagattctgtgatatattacttcttattcccagccttcaacattttaagaattcatattgaccttttctcccattcttatttcaagttatcagcatgttgatacttgggaaatcccatcaagtgtttaacagtgcataccttactgattcattatttatttcaatttaatctttcttattttcattcaacttttttctcagtaatacaactttttcaagctttttattttctaatgcatttctccaaatagcagccataacccttatatgccctctttcaatgacaacaacaaaagtgtgctaggcttcttggaagaaaataatgataccaattcaagaaggagaaaattgatgtactgataaacaaatgggcatcttaggatcatgtttctcacaagtaaggcagttccagaaattcctaggaccataatgggttttattctaaataggttaaacatatcacttaaaaaattgttttctacagttctctaatattgcttacaattgtccacgtttccatgtttataaacttgcacttttttttttttatggagttttgctgttgttgcccaggctggagtgtagtggcgtgatcttggctcactgcaacctccacctcccaggttcaagcaattcttctgcctcagccttctgagtagctgggattacaggtgcgtgccaccacacctggctaattttttgtagttttagtagagacggggtttcaccatgttggccaggctggtctcgaactcctgacctcaggtgatccacccgccttggcctcccaaagtgctgggattacaggcatgagccactgctcccggccttatacttgcacactttttaattctaagaccttgctactcagtgagggatcctgggactaataccatcagcttgacttgaggccctctttgaaagccgactcagaatctgtaatttatcaggatccccaggtaatttgtatgtgcagtctagtttggtagatctgctctggcagactggaagactcttctatctgcctcatgtaaggtgcaggtgacataattaggtaatcaagcaaaagatcacatattttaataagaaagagacactggctattattttgagtggtaaaacaggttattcagtcccagtttaaaatggaaatgacagagaccaagatgaagatttttaatttgagatgtgcctgcgatgcaattacatttgctgaatgaaactgcttcagtaattagatgcaggtttcttctctcttctttttgagatgtaaagaagacacaatagactcatggaacttaaagaactagacgccagctaacaaaacatgctatccaggctctttcgtttcaccatattgctttcttgaaaacataggacagtgccagtttagcactgaaaaaaatcagttctcctaattctaaaaagaggagacagccaggcgtggtgggtcactaaaaatacaaaaaattagctgggcatggtggtgcatgcctgtaatcccagctacttgggaggctgaggcaaaagaatcacttaaacccgggaggtgaaggttgcagtgtgctgagatagcgccattgcactctcgcctgggcaacaagagcgaaactccgtctcaagaaaaaaaaaaaagagagagagagagaaactgtaatttcatttcagaagttttatagggtagtatttccaattctttttttcttactccattaaagtgtaattagcagtatgtgaaaatttccactttatcctcaatcagaagcctctccttccaattagcatatattttttctattaactttgtaaagtgggattcttgttttatacatacccctggaaagtatacttaaactgtgagaccctgggattttatatttccaaatagaagataccatcctcttgtatcacaaaatgtacctaagatggtttggattatatttaaatattcttgaatgaaatagacttactgactgaagccaattattatatttttccacaccaaaataaatgcaataggaaaagatgacagttctatgtagtattcctgcttccatattgcacaaattagaaacatacatattccattatgttacagggtctagggctttgggaggacaaggctgcaggcagccgagattgtgccgctgcactccagcctgggcgacagagtgagatcttttctcaataataataataaaagtaaaaagaaatataatatttaatcaatatatgcacacacatgggtttatcatgacacacatgacatgtgtgtacagtgaaaaaaatgagtaaatctagaaacctgtattgcctcaatagctagctaagtacttcaatatgcatgtttatttcaacaattttgtgttaagcttcagtggtaaataagcagagtacactgaccataatgaatacttcttttgatgagggttatcactacacaattaaaatattacatagttggctgggcacgttggctcacacccataatcccagcactttgggaggccgaggcaggcagatcacctgaggatgggagttcaataccagcctgactaacatggagaaaccccttctctattaaaaatacaaaattaaccaggcgtggtggcacatgcctgtaatcccagctactcaggacgctgaggcaggagaatcacttgaacctgggaggcagaggttgtggtgagccgagatagcgccattgcactccagcctgggcaacaaaagcaaaactccgtctcaaaaaaatatataataataaatatatatatattatatataatcaatataaatataatatataataaatatataatatgtattatacaaataataaatatatatattatatataataaatatatcatatagatgatatagtttagagttaaatactgactgctcttgggaactttgaggtattctgagggatataaataacacgaagagaatagcacattggcttgaagcagattagagtctgctacctgcgtgaatacttgtttttcatgaactatgaggatgcccttagcttttgaaccacttctacttgtgttgaaatttaccctttaattttggggtttgacaggctctgcccttctgttatgcttgagtctggcttttcctactctgactcactttgattcttgacctctgaatcttattcctattttacaataaacacacatcgcacatatgccaattagtagagtggaagagggaaaaattgccaaggaactatgtttaattttgttcctttcgcaaaccagacaccataacagaaaaattttaggaacatgtgcatgttcagtagccttcaatgcaattatactggttattaaaaagtgttggataatcaatattttttaaagattcactagtcccttctgataattttagaactttgggaagtaataatacaaatgtatttttagctgtgtcctttaatcttttactgtttcctctatgtgtggtgtttggtttgtgtgtgtgtgataattattataaagatcagaggctaacagaggtgttaatcacgaacttttaaattttttttatttttatttttttagtttttttaagagacagagtctcgcagtgttgccaaggctggatgcagtcacgccaactcagctcactgcaaccttcgccttcagggttcaagcgattctgctgcctcagcctcccaagtagctgggactgcaggagggcaccacgatgccccactaatttttgtatttttagtagagatgtggtttcaccatattggccaggctggtcttgaactcctgatctcatgatccgcccacctcagcttccctaagtgctgggattacaggcgtgagccaccgcgtctggctgcatgaccttttaacttgtctcatacactcaatattctcaagatataccttccaaagtgcaaaattatggcactttgcagccctgaccactaactgagaactttgatgctttggattttggagacctcattttatcacctggtccttttacttcatgacttgtcatgctgccaccttttgatgggattgagatgaagataataattcccaactggtcaggaatattgtgcccctttgtttttatatccagatgcaatagagcctctgacacaccactactattgttcttaggatttggaacaaaatgcatttctttgacaaaataaatgttttctttaaagaactcttgattgatcctggaccattgtagaaactgaagtcctatcaatgcaaaaaaatatgacaacatgagctgcttatcatgaaataagtgttttccaattaactatcctgcttcatcagcaggtaggaataatagaatctatacctatgtcttcatgggaagttctctatggccagttgattagtgagggaaaaattgagcctgatttacagaagtcactgtacaacatcacagcagcagccaaaagtagattgcttaggcattataacctacgtgaatgcaattttaaaagaaattcagcctatgtaattggttgtccacgatgtctagaaggagagatattattgatgtatatgtggcagctaataatttgtctagataattagggacttggggccaggcctgatggctcacacctgtaatcccagaacttttggaggacaggacaggtggattgtctgaggtcaggagttcgaaaccagcctggctgacatggtgaaactccgtctctactaaaaatacaaaaattagccagatgtggtggtgtgtgcctgcaatcctagctacttgggaggctgaggcaggagaatctcttgaatccaggaggaagaagttgcagtgaaccaagattgcaccactgcactccagcctgggcaacaaagcgaaactctgtctcaaaaaaaaaaaaaaaaaaaagaaaagaaaagataattagggactcggaaagacaaagactgaaggattggtggcaatgagttttggggaaaaaatatgtagatgaaccacagaaaatgagccagagtgtaagaatatttgtgcttaatacgaatgctcaccaaactatcatcaggaaggttatcaaatagatatgaaggtatgaaacaatctctttcaccaggcactacattgcttgcttagaaggctaataaacagcaacattggtggtagcagtagagaatacacataggtttagcaacatgttggactttaccactctcgcttacaaaagcctatttagctgtcaagactattaggtgtccaacacacaagcaacaaagtccaaggctaagcacacaataacatatcctgggtgaataaaccagtcaccttttgtcagacttgttgattttattggaactcctctatgataaaggcaacaaggaattttgtaaatggaatctacctttaaccttgaattacatttgctttacctgacatcatttttctctgatcgccactctccacgggtacattgaatgccttatatatattgccataatatcctgttctacatccttctcttaaaagaacttgttgtataacaaatgagtagatattcattggactcacctggtccaccatttatcctatcactaaccaaaattattattattacagaatggtgaatattttattaaagactcaatcacagtgccagctggagacaatggcttataaggttgtactcatgctagaggatgtggtggtgtatcctctgaactagtaactaagtataagcttgtctggtgtctcctatataaaaaatacaacaatctttgatatttgttatgaatgttgaagtgactccttttgtcattacatctaatgatccactccaaatacttgtctcttgtctctgagattctaggtttttgcagaattagtacccaaagggagagtcttagcagtattccattttacaatccatccttcgttagaggatgagagacttctatctagccttttaggttgcctgagacctttaaacaaacagtcaaaaatttaaaatttaaaatgcggctacactgtggcatggggtagtaaatcttgaccttaaaactggtatttgtaagaaaaacagaaagaattcagggatcccctttgatggctcctaattctatacagtcctgtaaatattcctgaagactaaccaggcgtggtggtgcacacctgtaatcccagctactccagaggctgaggaagagaatcacttgaacctgggaggcggaggttgcaatgagctgagattgtgccacttcactccagcctgggtgacagagcaagactctgtctcaaaaaaaaaaaaaaaaaaaaaagaagaagaaagaaagaaagaaagaaagaaagaaagaaagaaagaaagaaagaaagaaatgaagactgccacaacttggaagcaaccaagatgtccttcaataggtgactgcataagcaaactgtggtatattcctacagtggaatattattcagtgctaaaaggaaaaaactatcaagccacaaaaagatacagaaaaacaaagacattttgctaagtgaaagaagccagtctgaaaagggtacatactgtgatttcaactatacaacactctggaaaaggccaaactataaagacagtgaaaagatcagtggttatctttgcagacgccaccatcgctgtgagccctgtactatcagccatggtcaactccgtcgtcttttttgaaatcaccagggatggcaagcccttgggccgcatctccatcaaactgtttgcagacaagattccaaagacagcagaaaactttcgtgctctgagcactggagagaaaggatttcgttataagggttcctgctttcacagaattattccagggtttatgtgtcagggtggtgacttcacacgccctaatggcaccggtgacaagtccatctatggggagaaatttgatgatgagaacctcatccgaaagcatacaggttctggcatcttgtccatggcaaatgctggacccaacacaaatggttcccagtttttcatctgcgctgccaagactgagtggttggatggcaagcatgtggcgtttggcaaggtgaaagaacgtgtgaatattgtggaagccacggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatcctagaatctttgtgctcttgctgcagttccctttgggttccatgttttccttgttcccttccatgcctagctggattgcagagttgagttaagtttatgattatgaaataaaaactaagtaacaacaacaacaacaaaaaagctcagtggttgccaggagtttggggatgggtagggagataaatagttctgaaacaggcgatttttaggggattgaaaatacgttggtaataatgtaatgatgggtacatgacattatgcgttttgcaaaactcctagacctgtaccacacaaagagtgaactctaatgtaaactgggggtgggataaaggtgacagtatgtgagaactctgtactttctgctcgatctttccataaagctaaaactgctcaaaaaataaagtctattattttgttaaatgaaagaaattaacaatgaccatggcacgctcacacaaaaagattatcaaggacatttctctgtcaggaatgaatatttggtcatttcacaaggcaaaaccctgactagcagaggtgttagctgagggcacatggccatagatgccaatagtgacctgctggccacttgcagaaaggagagccttgacatccaaacacattgtttctcttgtattgtcctgtgcatacttatgtatcttaacaactttccttctttcctctccatttatccctctttttaaaacagggcttattgagggtgattaacttaatttttaaatgatatatggcagaatgtcaagagagtatagtgaagaactttgtagaggaatggacataacccagaattcttagacttagagtacatgctgtgattgagaattttttattgtttcattgttcaagagattgtaggtacatgttcaattattagagaaatagttgcactctgttagaaggaagcttgggtctttcgtgtttactttcaaaagggaaagtttatattgatattgagcaagttaaagcatgaatatttactatttgatgtttgttcctgtgtttgaggaattcctcagcctctcagttttgacgaaaacaagaaaccacctcctgctttagaagctaaaatgtcaaatgcttgctttctcagcctcctttgcagctatctgttgcaaagcgaacaagtgggagtggtgctggtggctttgcagttagcctaggattgagcaattgctgcaattgttgctctctgcatcttcggtgttacttcttactggtggtgacagtggtttcctccctggatgagttctacagcatggtttggggtacatttcctggctgcctagctttgatctggctctctagccttctcaacagttctacaagttccccactatttctgtgataaacctatttattgttaatgtcagccataattggcttctgtggtttatattttttaaaattccaagatataccaatgtaacagatagctcaacaaacatatgtctttttaaattaagatatattctgtgtcacatgaagtacaatggacaaaatgcaacaaattgaattgagctaaagaccaaatatatattaagcctggctggtcttaaaaatgtaactggatacagccaggcatggtggctcacgcctataatcccagcactttgggatcctgaggtgggcagatcacctgaagtcaggagtttgagaccagcctggccagcatggtgaaaccccatctctactaaaaatgcaaaaattagctgggtgtggtggtatgcccctgtaatcccagctactcgagaggttgaggcaggagaatcacttgaacctgggaggcagaggttgcagtgagcccagatcatgccaatgcactccagctttggcaacagagtgagactttgtttcaaaataaaaaaataaaaataaaaaaataaaaacgtaactggatagacctaaggatcttgaataagcagaaaataatttaggtaaaaaccaaataataaactaacattctgaaaggtttaggatttggaggcccaaatgtcttagctaaaagtgttcattctaacctcacaggaaaattgaaatatgaaaatatacagaaaaatcttaggcagtatttatcaattttaagaaacaactatttacaggtttttcaataggcattacattaaaaacaaaatatatagttaataaatatgaaaactgtggatataatcaacacatttattttacttcttgaagtgttaacatgtgctgtctcaaatatcaacagtgtacacgtgagaaaaaacattttacatagattttctgcgacagaaaacagcatctcattagacatcccaagtttttttcatttggaacacacactcattccccagtatactaggggtaataataatttaaagagtttaattactttttactactagaaaactaattttatgtttggcacaaatttctgaaatgatattccactgcaaagaataatacctatatatggccagaattacttttcttctataacattaagataatacttgtcagcctgagcaacaaagtgagacctcatctttacaaaaaatagataaattagacgggtgttgtggtgatgagggtctgtagtcccagatactcaagaggctgaggtgggaggatctcttgagcctaggaggtcgcggttgcagtgaactatgattgcaccactgcactccagcctgggtaacagagcaagatcctctctcaaaataaaaataataaaaaaaaagataatattggtataattcagggtttttgcctcaatccccatgcttcttcatttgaccttccctgactccctgatgaattttagtttgaatttttgctatagtccagaagttaatttaaaagatcttaaaatttccacctgcctagatattacttatttgttacactttagtccatgatttctattgtcatttacattaccccaaaaatatgacctgctgaatttctgctgtcatgaattgactaacatattttgggcctaaaacctttacatttagaatctttttgtttcgtattggaaaatattgtaagtcctccatttattggtcaaaagcactgcctatttatttccatgcttaatcagagagactttccaatagttatttaatattatttacgttcattcacttgttgactatattgaggttagttgctatgatatctttaggtcattaatataataaaaatatgtcaacttttctcttccaatgtgtctttgggttattaatttttaactcaggtatcaagcttgtaaaatgtttaatggcttataataatgtctaacacatagtatccactgagttctgataactctggtttatcaaattctctttttttgtaccattctccaaatgcaatgctatttggttttatttttattttttaaaaatgtgctgcctgttttgagtctctaaaagtgtgaaatgctcagcatttcccaaatgtatttgaacatggagtgttatatttactaaaaagttaacaagcaagtattcccctaaacactctagcaaatactactagtacagacaaattatgatgtaacattatagtacattttaacttattaggttaattttggttgcaaacaatcaaaattcaaaatggcttgtataataaagagattttgaacaatagtataggctcaagatagcctaatgcagaagtttaataatgacacaaaataaatgcttcttgtcctccctgtttcttcactctaccttaagtgatatagattgaatgtttgtatcccccccaaaatttgtatgtttaaatctaatccctagtgtgatgatatttggcagtgggtcttcggggggtgattaggtcatgaggacagagccctcatgaatgggattagtgcccttataaaagagaccttagagaacttccttgccccttccaccatgtgaggacacagcaaaaagacagctgtctgtgaaccaggaaacaaatcctcattagaccctgaatctgttgacaccttgatcttggacttcctggcctctagaactgtaagaaataaatttatgttgttcataaaccatccaggctgtgatattctggtatagcgacctgaaaggactaacacattaggtctcagttttattctatggcttaaaatatcatgtcatgagtagacaacttccaatcctagtacctcatgcttcctctgctgcatttggaaagaaggcatttccctcttcaatcatggaatgaaaaagttgtacttcattctgatttgattagcagaaggcacaggttccttccatgcaccaattacaatgaccaagaattgggcatgggactcatgtcacttaaacattgtgaagctgagaaattcattatttggttaggagtgtgtgagagcagggaacactgaatgcttgagacaccaccacgatgtccactacatgtatttccatttcagtaaacatttccattaagataatgctagaacaaaatcagaggagtagatcttggtgtccccaacttttgttgacctaacaaagtgaagttgcttcaactggacacttctgaaccacatttatgcctatatgttcagttcaaatttattataagcaattttcaggtccatatgtttaggatatttcatttgtttggttatgcattatatgtatacatgtttttaacatacatacacctctacatatattttggaggcctttacacaaaagtgttttccctgaagggagaagagaaaagttgaatgcagaagtagaaaaaaaaattcatttgcacttgtagtatttatatctaaatattttatattacagatgtattaaaatttttataattttaaacactactttaaaacagggagatggtttaccttcaaaaaatttggctctcaactcaaagttatcaaagtatatcctagatgtagtttgcttgtcaggcttctacatgaaaatctaaaatgctcctgcatttcagaatgagcctaacatatgtaattgcactcatccactatgtctacattgccaaccaaatactgacagagagagctagagtgccacagagagctggcagttcctctgtttgcattagcttctacttgcttcttcatctttcctctatgtctgacacatttcatgttactgtttttaaatgttcccttagctacagagctaatgtgcttatatctgtaaggggtctcatgtgaacctctaaataattaaagattcattagctccctggagggccaccatgatttccaaaacaagtcacaatacctaaagatctaattgtacaatttccctcagaaatagccttgagaaagaagtcacatcactcagcaatgagtattataattactcacagcagttttcatggtactatataacatccaatttacagaattaaaggtaatgtaattcaaaagaaaaatagctggttttaaggaatgaagggccatgtcaactattggaagcatctttgaactggagcctctatgttcgggtttcaccaggtttatgtttttaattaatatcctattcagcttgctgtaatttccattgaggttttctagaacaagacaagtcagaaattgatctttaattataagctaagagcaaactgccaaagaactgagagaaattttgaagaaacaggtctatcaggactaaccattttaagatagtaaagactaatcagacacacacacatatgcacaaaaagagggagagagagaacaaaaatcctatgaaatacattttaaaaacttaatttttttaagaagaagcatttgatctgccaaagagaagagttagcagtttggagatctgacattgctaatctcagggcaagaaaataacaaaataagacaccaaagaattacctaaactgtggaagatgaagctttcagagttctcacagagaaatgggatactaaagtaccaagtttaagaggtgtaatctattaatgtttaatttatgtcccaaatacttaaaaactatgtttcattgttatacatatttattttattataaagataatgaatgcagtagggttagatttaaataattcattgggtttaaaatgagaaatgaaagtctggctttttacaacctacagtcttatcaccaaagttagctattgttaataacttcttgtccattcttgtatgtgttatggtttctttcttagaaagaagtatgctatactagtatacatactatttattcatgaaccttgcacttatcatgtaatcatatgtcttagtggtcttttcataatagatgtctctctttcccacgctgtcagtggtgattgcatgaggcattgtacagacgtaccaataattacttactctgtgtcatattgttggttattcagattgttttcactttgcccttgcagacaacactgcaatgaacatccttatgcatatattattccaaatacatcatcgtcatggctgtgtgagagaaatatacattgttgattttatttttttattttttataatttcaacttttgattttagatacagtgggtacatgtgcaggtttgttacatgggtatgttgtgtaatgctgaggtttgcggcatgattgatccgatcactcaggtactaggcatagtagttgtttttcaacctttaccccctccctccttctaccctcgagtagtccccagtttctattgttcccatctttgtgtccacgtgtactcaatgtttagctcctgcttataagtgagaatatgtggtatttggttttctattcctgtgttaattcgcttagcataatggcatcgagttgcatccatgttgctgtaaaggacatgattttattcttttttatggctgcaaagtattccatgacatatatgtaccatattttctttatccaatccacagttgatgggcacctaggttgattccatgtcttagcgattgtgaattacactgctgattttaatagaaaccactaatttttatgccaaaaaaatcatcaatgtgcacatgctccaaggctgtgtgagcatagcccttttccttgggatgtcaacaacactgggttttatcaaaatataatttttgccaatttattagttaacaaatgctaactcagtgctatttggatttgaactaccactggtgctgagcaactttttacatagtcactggcaatttatttatctttctctgttgtttatctttttctgtgtaataattttccctatcttctactcttttaaacattaagttttcactgttttcttaataatttttaagtttaaaaagtgaccttttggctgggcgcagtggctcacgcctgtaatcccaacactttgggaggccaaggcgggtggatcacaaggtcaggagatcaagaccatcctgcccaacatggtgaaaccccgtctctgctaaaaatacaaaaattggctggggtggtggcacgtgcctgtaatcccagctactcgggaggctgaggcagaagaatcacttgaaccagggagttggaggttgtaatgagccaagatcacgccactgtgctccagcctggcgacagagcgagactccgtctcaaaagaaaaagtgaccattttatctgctgcatataattctaatgatatttctcaattcgtttatcttttaacaatggtaatatataatgtcttgctatttagaaagatttttaaaagtattttacataaagaaatttttattctttgccattaatacttgcaggtttggaattttcaggacctcctcaaaggccacctacaggaaatgctcttcaaagacatttcactttttccccacttgattgtggagcaaagactaacactggcaatgctttgaagtacttgagtcaaatgggtctctcatgtggtcattactatactcactctcaggctccaatgcaaattgtttccttacgccaactactcttgctttcctttaatagacctattcctcctgggctgtctgaaactaacatttcattgtaaataaagtcctgcaaatccttggtatctcaaagaaccctccttccatttagttttaggagaactctccttctaaaactctattcttctccctggagtccagatccccattccttgcaacaaatgaacgcttgatttgagcactgaagggagataattggaagtttgactttgtgttctaggttttccctgccaatatatgcagcgtctttaaaactaattgggctgaggcaggagaactgcttgaacccaggaggaggaggttgcagtgagccgaaattgcaccattgaactccagcctgggtgatagagcaaggctccatctcaaaaaaaaaaaaaaaaaaacagcaaaaagaaactaattaggttcaagaagttcgaatgaattcaacttagacaagctcttaagcagacatgttggaagttccagaaaagacagtttgggaaaatattttattaaaaaaaaaaaaagactgtcctccacttcctcactctttcttcccacttattttcactccactggtgcagtttggtgtcaactctcctcactctactgaaactgctgcagccgaggttactagttatttaattaacaaaagcaatagattttgttttttttaattgcattatactctactattttgtgacatttaaactattgacaatgtctttcttgaaaatgtgtcctttttgtttttttcaaaacacgactttctccttgatgtcctcctttttctctcattatttcacctttacattctctgctgacacctttcaccttaccaaaccttaattaaatgtgtatgcttcccagtctcccattcttggctctcttcccttccctcttattgatcattattgtattctgtgatctccccaattctcttggctttaacaataaccagatgactccagaaaactattcaaaattccggacctatggagactttgcacccagatatgtaccaacaactcaacctcagttatctctaatattatctcattaagtgccctctaactacagaatgactcctccttctgggtttcctctgcctgaatggcaccaccattcagtggcccacgacaaatgtggacctcatttggaacttctccctttccctcatgtttcattttctcttggctaaagagttattagattcttcatttttagcttttctctagcctatcttcaattttatagtggacagttatgtataccctatatcccaggagagaagggatatcttcttctatgcccctactatgaactagcatatcctttgagtcctttctttgtatgaagcactggggaaatttaatcaacttcataatcacttataatcctcacagtaattttatgagataagttctatttattatccctatcttaaggatgaggaaactgtggtttaaagagcttaagtaatttgggcaaatcatgaaagaagcagtgaagacagaattcaaatctaggcaacctgaaatctgagcctgagcactttgcctccctaataactatctccctttgagagttgtattacaaagttgacaacatttagcaacccttattcccctccccacccctatctctctccaagaaatctgctgtgaggtagagaatgtgttgattttctctgcagtttttagtgcatagcatagggcttagaaaggagaaaatgatgaaaaatatttattaaaataattgtttttctttgatagttgttataaccatctaattgtgagtgcttaacaattactataaaggagaatggaaatcacagatcttttcacagaattttttttttttttttttgagacagagtccagcttgtcacccaggctggagtgcagtggtgcgatctcagctcactgcaacctccacctcctgggtttaatcacttgccttggcctcctgagtagctgagattacaggtgtgcaccaccatgcctggctaatttttgtatttttggtagagatggggtttcaccacattggccaggctggtctcaaactcctgacctccagtgatccacccatctcagactcccaaagagctgggattataggcttgaaccaccgtgctgggcctttcttagagaatttatagtttacctggaaatgtaaactatatatatacttaaactgagggatatttacaaaagagctttctacttaacccacaagaagctgtattaataacaaagcaaatcaagcttgttcacaggcaactgaatggaatgaatggttttgattggtcttgccagttatatttctaacaagagaaaattcaatgtgagcctcatttggaaacaagatattacagagaggaaaatttgggattaaggtcagatttggtgcaactatgctagatacagaaaaggcaaactttcagctcaatccccagctaagtacaagttcaatggtgaaggcataagaaaatgagccattataataagtctgaaataagtttatgattccacctcaatatgggcatgcaatatattctaacatttaatccctggaaaaaatgatgacatcacactgaaatcttgactcataagagaacttttttatgctgttccctaagtcagtttatttctacttcattcttgcgttaagggtaggctcaattcttactcattcaaaaacggtatcacctgaagcttttctttaattcttgttttctctgcagtgagaaaattaaccaaggggttaaaatgtatattaattatatatgtattatatgtaaaagttatataatatagatcagagaagaatatattgcatatgttataggctgaattgtgtcctttccccaaattaatatgctgtaccctgccccctgccatcccagtatatcagaaggtggctatatttggagatagagacttttaagaggtaactaatgtaaaatgaggtcacatgtctgggtcctaatccaatatcactggtgtccttatttgaagaggaaatttaggtacagacatacatgtgcacagaaaaaagtccatgagaagacaagatgagaaaatgactatctaaaagccaaggagagaaatttcagaataaaattaacacatctgatgccttgacctcacacttctagcctccagaaccgtgagaaaataaatttctgttgtttaactcacccagtctgcagtaattgttataacaaccctaacaaagtaatataggaagtatatatatatatatatatatatatgtgatagagtagatagatagagacatatacagtcatccctcagtattagcggggtattgcattcaggagccctgcatataaggaagtctgcacatactcaggtcccacagtcaaccttgcagagctcgcatatgaaaagttggccctcaacatatgtgggtttcacgtcccacaaatactatattttcaatctgtatttggctgaaaaaatccaccaataagtggactcacacagtttaaaccagtgttattcaaaggtcaactgttgatatatagatatataaatatctcatatgtatagagcaagcgagagaaaaaatctctaatctctcttccttcctgctctttttggattgcaaactcttctctcataagtacaaaaagtaatgttaacaaagtaaagagaattggaaatagtagtgtttttgaccactagtgttttgtaattttggaaaaaaaaattactgaaatgtaactttttatttatattgagatgttttgactcatactccaatcatacagaaataatagataaaatatgaaaaagacttctttttacatacatagctggattaaaatattagaaataattttcttccctcaaaggatcccctatttaataaacggtgctgggaaaactggctagccatatgtagaaagctgaaactggatccctttcttacaccatacacaaaaattaactcaagatggattaaagacttaaatgaaagacctaacaccataaaaaaccctagaagaaaacctaggcaataccattcaagacataggcacgggcaaagacttcatgaccagaacaccaaaagcaatggcaacaaaagctaaaatagacaaatgcgatctaattaaactaaagagcttctgcacagcaaaagaaactctcatcagagtgaacaggcaatctaaaaaataggagaaaagttttgcaatatacccatctaaccaaggggtaatatccagaatctacaaagaacttcaacaaatttacaagaaaaaagcaaccccatcaaaaagtgggcaaagaatatgaacagacacttctcaaaagaagacatttatgcagccaacagacacataaaaaatgctcatcatctctggtcatcagagaaatgcatatcaaaaccacaatgagataccatcacatgccagttagaatgatgatcattaaaaagtcaggaaacaacagatactggagaggatgtggagaaataggaatgcttttacactgctggtgggagcataaattagttcaaccattgtggaaagcagtgtggcgattcctcaaggatctagaactagaaataccatttgacccagcgatcccattactgggtgtatatccaaaggattatacatcatgctactataaagatgtatacatgcacacgtatgttaattgtggtgctattcacaatagcaaagacttggaaccaactcaaatgtccatcaatgatagactggattaaaaaatgtggcacatatgtgccatggaatactatgaagccataaaaaaggataagttcatgtcctttgcaaggacatggatgaagctggaaaccatcattctcagcaaactatcacaaggacagaaaaccaaacaccgcatgttctcactcacagatgggagttgaacaatgagaatgcatggacacagggtggggaacatcacacactggggcctgtcagggggtggggggctgggggacagatagcatcaggagaaatacctaatgtaaatgacaagttgatgggtacagcaaaccaaaatggcacatgtatacctatgtaacaaacctgcatgtgatgcacacgtaccctagaacttaagattaaaaaaaaacatttcttccctcatgaggtacaaagccaagcattacactggggccatgatagtccaggttgctgaaagatttagatctaaagactgaaaattgggatatatattgagagagagagagagagagaacaaatggtaacctaaatttaataaaataataatagacaaattagggtaacaggcatatgagtactttttgttctaacaattcttttattttcaaacttatctatgatcttacatttatttcccaataaaaaggattttaagttaaaaaaagaaagtttttctttagtaacattttcacaactagggcctttaagactgaggaaatactccaagctctgagcaaactcagtaagtataaatccatatgtagacataccacagtaaaatgcaagatactaaacactaatacaatattttcaaatcaaccagagacggaaggcagattacctgcaaaggaaggacaattactttatcacagacttctcttcatcaacgagaacagacaatacaggaagaacatctcccaagttgtgagggagacgaacagatgacatgaaattctacgaccaaataaagcataattcaatgggcagcagttaacagaattaagctgtttccagacatctatggagagatttaactcaaagatgtcactgtaaatttgattgttgagatgtagtaatggatacttggcaaggttattgaattagttaaacgatcttcaaagcttaggtcatgtatcttcattaaacacatggtgctttgcatttactaaagaagggcctccgttttctctccaaataaatcattgcgaccttagcaccccaagtgtaaaaacctcttttatttctattcttgatctctagtccctgcttatgtgtatgcataaatgcatgacaccgtgcttctcttttagttatttatttctagagatcatgtctttgaaaatcattatattcccagcaactatttagagtggtactaagctaacttggtttatggtgtcaaccgcatagcagttatttgattggcccattcctttataaaatattttatgcttagatgatgaactctacataaattcagccaggagaatgttttccttggcaatctctgggagattacaaatgttcctttttttttttttttttttgagatggagtctcgctctgtctcccaggctggagcccagtggcgcgatctcggctcactgcaagctccacctcctgggttcacgccattctcttgcctcagcctcccgagtagctgggactacaggtgcccgccaccacgcccggctaatttttttgtattttagtagagacagagtttcaccgtgttagccaggatggtctcgatctcctgacctcatgatccacaagcctcggcctcccaaagtgttgggattacaggcgtgagccaccgtgcccggcctacaaatgttaccattaactcctccttctgctaagaaataaaccaaaataaaattattcacaaatataactgttttgatcatgctttcagatgatatgtaaagtagcccacagaaggtaaataatattcaggggaaataaattattacttaagagtgggtgctgagaaaaagaaatgtgtgaagtgtgaggtaggaagtatgtgagaaaagctagggcacagttgtgtcttatatttttgttaaaatctgcctgttaagacttcctgattgggtaatgggaatgatacagtaaaatactcttcctcagagtgtctgacaccactgtgataatttactacataaaagtacaagttacattatataaaaagaatggcctggctcagtggctcacgcctataatcccagcactttgggaggctgaggcaggtggatcatctgagatcaggagttcgggaccagcctggccaaaaggatgaaaccctgtctctactaaaaatacaaaaaattagccaggcatggtggcaggcacctgtaatcccagctactcaaggggcagaggcaggagaatcgcttgaacctgggagacggaggttgcagtgaactgagatcgtgccactgcactccagcctgggcaacaagagtggaaactccgtccccccaaaaaaaatgactccaagaaactgaggtttccagatgagggttacacaatgtggatctaaaagcaacagggaaaggaaaaggatttgggcctagaatgtggggaattttagatgctgcagaaagccttctggtgtctttctagaatggctggattttggttaaggcaaagaagaagtaacttttcatggagaacagtagcatacaggagtgcggatggtttgatcatttaaggcagggatgtgaggtttgatggaatatgttgataacaaagattctttgcttggccaactttagtcaggcttctaaatcttcagctaggctaaactgtgcacttcctcgcaaaatccagcattagcaaagaacactgccaagtttaccaaagaacccctcattctcaatatctgatcaggttcttcattcttcaccattctgcaggtgatgtctgatcaccctggccagtcttcagcaagaattcttttagggcggtttagccagaatctcccttactcctgatgtttcctcttagtgattttccattcactgacccctgcattgctcctgggctataaattcccacttccgcatgctgtattcagagttaagcccatctctctccccagctccaagactgtgttgcagtggttcctatatctatggtgatggtcctgaataaagtcttctttactgtgcatttgaagtatcactgaataattttttctttaacaactatggtgttgaaactcaactaggacagattcatcactggatcctgggcctctcactcagaaccctaaatgcatgcctttgaagtctttgttgtcatttctgactgattagggatccattggtgaatcagattcctgagccattgctccagacaaaagcccgttgatggctaaggacagattttgaatctgaagggatgaatattctctctgaagctggggtagagtcccaggcttcttttgaaagcaatcctctgggcaggaaggtcttcgtgtgggcttcttgttctgagtggtctattctctgagtccctaggctagaagtctcttctttctggctctctttttctgagtgaggggttattccctgattccctgggctacaaattgttcttcctggctctctataaaaccactctgctctttctcttctctctattggatcctgcttctcccatgggagctctgtcacctgaaacccctcttctcaagtctctgctgactatttccatagctggtagtcacgacgaggagacaactgtgtagggtcaatatttgggccaaccaccctgaggaactgtgagggttagaactggaaattgtcaagagaatccgaacccagctaccatataagagagttcaacttatgttcaatgtgaatgccatggcaatattaaaaggtaagaattcaatccatacgtgcttgaggtaaataggagaaacctagaatttatgtaaacagtgagaagattggatgcgttttccgtctcatattttaatactggcagcatattatatatgtcaaaccatcaggcattcagaaatacatgcttatgaaaattttttgcaccatcagacaaaagacaagggtagaagacatttgtaaccctataaacactagtaaattaaaaacagaaggaccttaatgtcctaacatacctgtgttgtgaaaggctgccctgtgaaataccggatttcttaaacatattttaaaaatcataggcgtcaatattttttagatatccttttaaattttctcttgttattttacaatgcctatttatttatttagtggctctgctgattttgatgtatatccaaaactttatattttctttaaaagatgttttatacaactttacgtaaaatgtttctgtatcttcacattctctccctgtccttttgttttgctcttatatggtggtcctgagtcttttctctggcttttcaaacctagtaagactaagacactaaggtaactttgcccgtggtttggtaatgccttctaaagcacatcctaagctctcgtgcatacaggggtctcctttgagctctgtgcttttgagatcccatacacctaaattccagtactccaaatcagtactgctcagttttagtgactaagtttaaaaatgtattttaatagcaagttagtttagtgccctcttgcttctttcttgactgcttgtatacatgtatattcctttaaatgaatcttggaatttatttagaaatattaaattatactaatgaaactgtatattgttgtgaattcataagtgaatttggaaagaatttgtctttatgatgctaaatcctttttatccaagaatcatatgtgtctttatatttattccagtctatatttatatcactgagtaaatacatagaaatgtggatacatacagctgtagttacagatacaaatatagatatagcctgttaaatctatatctatcccatataacatatatacatgttatatgtgtgtgtttatatatatatgtttatgtcattaaagagctcccttaatatttttcttttatttcccataaaatttaggtcgagcttgaattttgcttgtataaacaagtaaatatttatactagttttaatactgatgtttagacattgtatcttattttagtgctgaatattttcacaattattataaatatcatctaataataataatgtacctgataaaaatatttaaaattttacctttgaattattttattgttgaattaaaattcctttaatatgatagtcaatttctgttttatgctttctctatgcatatgcaaattaatgtatccacttctctgtctctatgtagtaacatatgaaaatcaggcctctcttcttctaatggacatacacatgtttgcatatagaatatcagactctttatagcatttaaaacctttaaaaacatgaatattgccttttaacaaacatattttagcatgtactgagaatcccctatttatttttaatttgggctaatcaatacgattattaatattactggattaccaaatttggaaacacactttcatcccgaaggtggatatttgtttttttttttttttttgccaatttcttgtcttactgtttcaaatattgttggatattatttgtattttatttggcattttagtatcaacatttgtaattgaggtactctacatattttttcatcaatatctggtgggtttcatagttactgctatattggatttgtagtagacattgacaaaaattattcctgtatgttttatagctgtatgaaggaaactaatatattttacccctaaatatatttccttgatatatttcaaaatggctattgagaagggctggaaaagcaatgttagctgcaaagctgtcttggggagatttgcatcggtagagaatctgccctgatgcagccaggttttctctgaggtctgcccccttgtctggatctaggaaaggttaactgagaggctaagtctccaaaggtctgaaagaaacattttctgtctattctctctgaggactactcccagtgaggttccacctatataataagtccactgttgctagccagggtcgttttctcacataacctttttctttcttttccctgtgatccaagaccccatttttctgtaaacttcatgtggtagataagcttctgcacgcatcgtgtgactgggtcttcgttctaagggttccagtgtacacacattacagaaacctgcatgccttttctactctttatctgcctcctattagtgattttcagggagacttcagaagacaaaagggacattctcctttagcctattctcagaccaattcccccaacatttaactgattcctaatagcttaaaatcactttgaaaaatccatatatttataaccttttcttccctctatgatttctggtcagcttgggttttgtttttcattccatttacttcatcctcgaaaagatctattttacgtctatttattctcatttatggacattgagaaaagaaaataactttcatgtgagaaatgcaagtcctttgaaataatcaggcccagagagatattcaaatgacacagcagttctgtcctgctcctctttgagctgtgtgttcatctaggctgcttgctgttgccacagtagctataaattaaccaataaggccacaccagacactataatccacaccccataatagtgtaacagtgtgtagccagtcactaataaatgttatttccataagccaatgagaatttgtgacaaacctctttgcgtcatcacacttctggacccttttttgcctttaagtaactgcttgttgcaaagctccaaagggagttcacatccaaggatatttgggtctgtttcttccaggcagctgtcctcactgtggctcaagtaaactctttgaattacattttgtgcttcagctccttccacttagattaacaacatggatttgtgtcaccatgtacagcaattaaaatgtttacacttttcccctcgagagcactgatgtgttttcctgagcacttggaatagctacgtagtgtttcctgtctagattatggtttctcaaccttggtgctacttacctttaggaccagaggattctttgttgtgggaggctgccctagcaatgataggtgtttcgtttgacctctaaatttcacacctccaccagtcttgacatccccacgataaccctagacattgacaaatgtctcctggggaaaactctccaccagttgacaggtaaagttctggaaatattggatttgtcaattgagattttatgttatccaaaacaaatatttttctttgttcttaaacatctacttccatctacttatctacttatttttacttttatttgtaacttaattccatcaaggagagagagtgcattttctgttatgctaaatttttgaagaatgtattgatattttatgacctgatatatggatgatatgtagatattacatgtttgtattatcaaatttcagggtgataataaaataaatacttataatatttatattgtcactgtatattagttattttctttcttcactacaggagtttttcaacctataggctatgtttcaattctaggttatccagtagattttgaaatgttatgattaaatatctacttctcaagcattcatctttgcaaatgaaacaatcctaagctcttataatacacatcatataaagggcagattagtcaatgtatggttcagaaataattaagtaatatttataagaaaattaaaaatttatatccttaactcagataacaataatccaaattaaaatttgatttcattacataatttaaaatgacatcagaatgctagtaaaaattatacaaaaaatttatgtaatcttattaagctgtgggactttattagcataaattcaaatacaggaaccaaagtaagattgagacctatagtcaaaggttaaaatgtacacattataggggcatgattaaactaatttaaagcataataacatggagaaatattgcaaaacatacattttactgaattaattgttagtatctaatcattttgtgagaaccaaattaaaaagtagctacacacgcacacacccacacacaagtgcaatactgtcaaataaacgatgttcagctacactagaaatcacacctgtgttttctccacagaaaagattaaaaatcacaataatttttattgtacatatggaggtaaagatactcaaaatattaccctaaaatacattatttttttgagatggagttttgtttttattgcccaggctagagtgcaatggcacaatcttggctcactgcaacttcagcctcccagggtcaggtaattctcctagctcggcctcccaagtagctgagattacaggcatgcaccaccacactcggctaattttttgtatttagtagagacggcgtttcaccatgttggtcaggctggtctccaactcctgacttcaggtgatctacccacttcagcctcccaaagtgctgggattacaggcatgcgcctggccagctttttgacatatttcacgatggctactcggaagactggagatagcttcttctacaagaatagctgaaaagctgtgtttgttggggagatttgcatttgtagagaaaatctgcattgatatagacaggctttccctgagatactcccttgtctgggtataggaatgattaactgagcctggcacgtttacatttctaaaagccatttcctatctatacttcccaagaggagggctgctccctgtgaggtttcatccatgtaacaagaccacctctgctgccaggctcctctttcttccttgtcgtcacctgtcttccacaaagcctgatttaccaacctacagctctgtgttttctgcaacctcaagacagcataggcgtgttgactaccttgcctttcctggagtttttatataaagagtatatatttgtatatctctttataatatacaaatatttgtatagatataatatatatattatgtaaactccaagtgcatacttgtgcacatatctgtaaacctttttttcctgttaatttgtacattatcagtttgttttatagactcaaataattaaagcttcaagggaaaaatttaaattttcctatagagaaaagacaaatatataggtgacaaataatatttagagtgtaagacgctttttaaaggtatatttgcaatttgtgtcaaaacattgaaatgtacatttgttattttaacaataaaatttcaattaatttaagccaaatacatagtatatgcagaaaatttagcaatatatctatgtagcaccttactgtgcattattgtaaccagccgtctaatataaagaattaaggtagcagctgctttccaaatagcgcatttttttcacagacctattaaataagacaaataacatttaaactttatttttaaatttgcagaatagcagttttcagcagatggtttattttagcaaattccatcttcacattgtgctatgcttttatgagttccagctgttaacggatactattttactgctgaaactatcctgtgtgatataattgctcattatgtgccttaaaacacaagcaatataattattttcaacttggagcaaattaaaatcttatcagcaatttaaaatctctagagtcatcttcttctggttaattattttaaacttgtatttttctctttatgtttttagtgagttctcttatcaaggagaagatctcaaggtgattattcttttttttctcttccatgcacctcgcaggtgtgttaataatttcatttctcagaaaatattctttcatatctatcttacaagatgagagaccttttaatatcttccattcggatgtgataccagtaatggaacatattccagcttcatgaatatggtgatacaaatagttattcatctaacctctttcagtgccaaatgtttactatactcagtgagttactcagttgactggtaatttcttctgaaatcactaatgagaggatcagaggtctggctgttgtctgtacctcatatgactcccagtgcagacaattgtttctatggagcacagacagttgaaaggattgacttcctgcctagaatagtttctgctgtgcttcttatccttcttgtggagatttcagattacctgaattgcttttctatcttaagaaaaaacgcaacaattctcccacctgagaggaatgtaaactgaagtaagttaacagaaccaatccataaagtttttacattgtttgttgcaaaatgcagcgctggtgtctccatcactaaccttttctatccctcattgctctttctttgactgcaataggatacctctatgcaaatctgtattcccgagactgagtgcccttttggtgagctataagcacactcaatggtaggctgaaatactagtttttatctatggcgaaatggaatcatatcagtgaattttttaaaaaggaaatttaactcttgctgtggtttgaatgcttgccccttccaatctcatgttaaaatttgatccccaatgttgcaggtggggctcactgggaggtgtttggtcatggggttggaccttcatgaatggataaaactctcccttagaaatctaaagctatcctccctcctcggtgccctcaggaatgagtgtaccattccttattcacctatgattaccccacccatcctttttgagatattgactacatgtatgttacactgatgcacattgtctgacctatgagtgagtttctggttttcttattttagtttaccgtttgtcctttagtttgtaatgcttctaatttgttctataaatgttctgatgttagggtaaaatccattacttattctatctcatggaatttttatttcaagtatttatttttcatctatatatgtcacatttttcattttataacttttatttttctcctatatttaattttcatttaagtaccttgacatatatatgtatttatctatatgtatttataaaatatatttactttaaggatcttgaaatttccttcttttctgtcatttataaatgacttatttttatcctgttaatatatattttaattatatatgtcttacagcttctttgcatttcagagttttttttgggtattttgatgttatgctattgaatatctagattttattggctacctttgaataatgttgtgacaggcagttcagtaacttcaggatgagtatttgtctgttgttttaaatcttctctttaaactttgttgagttagtctagagccatctgtaatttggagctaaatgagcactgtcactagggcatgaacctccagtggtctttactgaatatcctggaggtacagaggggattcccttctctgattagaatttggaatataaagagaaaagagaaaaatagaaagctatgcataaacacgtgcattaaaatgaattttatgtgggctttttcatgaaaatgttcctaaggtattttattttttttattgtggtaaaatacacataacataaaatgtactctgttaaccattttaagtgtacagttcagtggtactaaatatagtcataacattgtgcagccgtccctaccatccatctccataattcgtttcatcttgtaaaactgaaactctatacccattaaacaatacttccccatttcctccttcccccagcttctggcaaccatcatcgtaccatctctataatgctaatcaagcatagtggctgtgtttcttgcttcctctagtccgcaggtagcatacaaatgtaataaactacttattcatgtcgcatctatttattttctgccttataccaagcttgtgggattctcttaaatacaacatttttatacttacacctatgcaatacccattagcatcgccttcctaaatcaggggaaattgagcttctgtcaggtggagtaacttcctaagatataaaactcagcattgaagtctgtatacttcaatatcctgccctcttctcatgtgtctttactgccttttatgtatgtgttagatgttcaacaaattctcttttttaaactgaatttaagccgtggagcagtgttttgttgaacaataaatatgatataggacactcttcctccttttcatgtatgatcctgttcatgaaaaagagaaattctttcattgtgctagaagcttaaaataatgaaaatgccactttctacattaaacagaaactgaagggaatcaaggtgaattgcatgagacatagaaaacaagtgggaaagaaatctagtataatttgccctttgtgtacctttattatttagcgtttgagtaaatgattcccccaaatatcttcccatctcaattcatgtctataaagtagacgtttatgtctcaccttgtcaagaagggcaaagtctaacataaacatttcccaaaaatgcttcctgctaaaacgtaagctcagtctggctagaaatgcagctcacttcctaaagattaattggtagctaattttgcatgctgttctctgaacttgagtgtaacctgtccgtcaggcatacagggaatgacgggaaaggtgacaacagaagatgaatgctatgtcactaaccttcaaagatgacctgccttttctttcaaattcttgatatcttaagacttcattaattcatctctcttttcccttggttcaacattttgctataccaaaactcatgtgagacaatgacctaatgtaataaaaatggcatttttctttcatgtagttgcaagctaactggcatttttacaatccacgtatttcctttgtcagtttttcattctgtattggaagtaattgatgggtatttctgaagggatgaaggtgtttctgtgttcattgtgatccaaactatttctagacctaggggcctttgtaaacaatttgtgcccactgaccaaagatcactgtggcagaaagcagcaaacttgcataagatgtcactgcttcataggttggctttgaaaactaggggcttactctatactcttatgaataaaagacattgatagatgtagtataagattacaatcatattttccttttgacagtcacattataaatcaagatgtattgcaattaatctcaattagctgatcacaattaaaattaataatgtttattattgctgataaaaatcatgtctctcctgttctcaaatgtgcaagtaattcttgtaattttaatacaaatttgcatattattattaattgatttaatctcattggatttggttcatggatccaatttattaaaatattgataatgggataatgagttgtctccccatttcatgtacattaaaaacaacatttcttacaatggtctgcaagcccatcatcatctgccgcatgttaaccgccaaaattattttatatcttcacccttgatcttaccagtggtcctggccacctcactgtcctctggacataccaacatgctgctgccttacgatcaagactctagttaattttttggcttggaaagatagcccaccatatatccattgatcagctcattcaacttcctcaggtctttactgaaacttcacattctcgatgaggcctattcagtatttcaaactgcatcccagttgcaacattccaaaaccccttactcttctgtgtatttttgaaaggatttattgagatataatttacatagtgtagagtgcacacattaatgtctacaagtcagtggcttttagtatatgcacagataagtggagccaccatcacaatgaattttagagcattttcatcacttcaaaaagaaaccccaccttccctagctgttaacctcctatgcacccatcccctactcaatcctaagcaaccacaaatctgttttctgtctctatagattttcctattctgttttcatctaaatagaatcgtacaataggtggccttttctgcccggcttcgttcagttggcataatgctatcaaggttcatgtacgtattggtactttatttctttttataactgtataacattcaatttcatggatataaccttttgtttatccaataatatttttattgacatttgagttgtgttcagcctttggctattttaggtactgttgctaaaaatacttgtgtacaatttgtgtttgaacacctctttccaataatctgggtgtatacctaggaataaatttctgggtcatatgacaattctatgtttcatatatttagaagccatcaaattattttccaaagtggtcagttctagccatagagtatctaactgtggttttgatttgtagttgcctgaagagtgatgctgttgagtatatttttatgggattattgaccgttcatgtatcttcttgggaaacacatctattcctatcatttatcagttttgagttgggatatttgtgacggagttaaaccaatttttctatattcaagatacatatatatatacagacatatagatacgtgtttttcaaatatcttctcacaattttggagctgccttttgacttgcttggttgtcctctgaaacaccgatgtctttaatttttaagaaattttaaatatctaatttttattctgttgctcatgtttttggggttacagctatttctttgctagatccaaaatcctgaagattttcccatatgctttattctacctcttgcatgtgtgtctttaattcatttgagttaatatttttgtatgctttggggtaagggttctaatttattattttgcaagtggtgatccacgtgtacgttgttgacccagtgtgttcaaagactgtctcttcctcattgaattgcacatggcaccactttaagaatccattgactgtagacacatagttttatatatggactctcaattctcttccatcaatctatatatttttccttcatcaatgttgtgttgtcttgattactgatactttgcagtaaggtttggagcatggggtgtgaattatcctaatatgttttctttcttcaagattattttggctattttgagtcccttacaatttcatgtgtattttagaatcagcttgtcagtttctagacacaagtctgttgggatacttgcagggatttcatcaaatctgtagttcaaattgtaaagtactacaatatcaaatcgtccaattcatgggtgtaaggtgtttactaattatttaaatattctttaaacaataatttttaattttgagagtaaaatcttgtatcacattttccaaattaattaatatttcttttttttatgctattttaaattgaagtgttttcttaaattcattttggggttttcattgcagatgtgtgcaattgatttttgtacatttaccttgtctgctgtaatattgctgaaataatttacgagttctatcgttcggtggattccttaaaattttctatatacaacaatgttattttcaaataaagttttatttcttcctgttcaatatggatgactcttattattttagttgccgatttgccctgcataaaatctttagtacagtgttgactagaagaggtcaaagtatatatcctattcttatctctgaccatagcgggaaagcatcctttaccattaagttgcctgcttgctgttggcttttcacaggtgccatgtatctggtgtagaaagttctctattcctggttcattgagtttttatttttatttttaatcattaaagcatttggattctgttaaatgtgttttccgaatctatcgagatgatcatgaattctcttttcttattctatggataagatgtatcaccttaatggattttgggctgttaaaccaacctgggattacttgtataaatttcactttgtcatagtgtataattcttttatatgttgctagatctgatttgttagtattttttaaggaattttgcatttatacttatagtagttttatttttctatgctatttggactaatttttgtatcaaagtaacactggccccacagaataaattggaaagtgaatatttctcttttttaaaaaagctagtcaagaattaatatcaattattcaacactaacaaatattattattataaaatattaatttctctaattttaattttcttccttctgcttgctttaggtttagtttgctattcgttccagtgccttaatgtggaacgtcatcttatctcatcctttcctttgtcttttcattttgtaaatagtgtcttgttagcatcaggtgagctccccaggttggtagtactccatgtttgttgctgtacaacaatgacaggtaatatgtcctgaagacaatggaaacttaaccttcaaaatctcctagattccaccttatatgatatgtctcttctattggtcctaatttctaccctttctctattataaaccatgagtacaatggcattcaatgagttctgtgagtctttctagtaaattcttgaaactgagggtgttcaggggaaacccctgaactggcagttggtgtcagaagtgagaatcttcttacatggcctcttcctttgaactgtgcagctggacgcaaactctgcacaatttgggccagaactctcgtgttgactttgtagcctaaagtatcttgtagtttgtctaaccctcaataaatttgctttcatcaaatattgtatttgttaccccaaaattaccatcacgtttttttttctccaaataactaacataggagaaatagccagctgagtttgtaactcaacagaaataagtgatccatataccatataccatataagtggccatttcattttgccttcttccaccaaatcttagcaacctcaaccattaccaagagccactgtaggcctaccagctacaaacaaacgagtatcttgtaaaaacacttcatactcccatttgataattttcccagcaaagagatgcctactttaactctatgcaagtggctcatattcacgaagtctgtagatattattcatgtagagtgagaaaatcatcccagcggtgccagcacattctccttcccatgatctgcttagtttgcaaacatattcaggccatgggtgagagatttgtatttcacagtacaacaattttatggagggcattgaaacttacattgagcattttagtacagtcacacatcactgaatgatagggatacgttttaacagatgtattcgtaggcaattttaccattttgcaaacatcacagagagtattacaaacacctagattgtacagcctaccacgtttaggttatatggtatagcctctttctcccaggctacaaatctgtgcactacattactgtactgaatactgcaggcaataagaacacagtggtaagaggttatgtatctaaacataattaaacgtagaaaagtatgtaaaaatatctattataatctcatgggaccacttttgtatatgtaatccatctttgactaaaatgttattatgcatgacatgactctatgacaaaaataaaataacacattgtaaaaaaatatacacaggtatcaaacatattaatattgtaaaaataaaaatatttattcagtgtaagaattcgtaatgatcacaaaatgttcacagcttatattttagtacagtttcaaatgcctagtgcaattgctatttatttctgtattttaaacatgtatataataaatatttttcaggttcaacaatatatatcaatccaactggctcttataaatattagttaacatcaattggtaaattcatatatatatatacacacacgtgactcagtctgtatgcgtgtatgtgtgtgtaaatgtaactgtatgtgtgtgtaaatgtaactggatgcatcctaatatttacccttacctacaagatttccaagactcatttattctctttaaatggtgtgccttgaaagatttaccaaataaaaccgcaatcgtggaatatatcaagatgttattaaattcatcttgtgcacataattgtttctttaaatttatgtttcttgcaaaacttgcggtaatgctcatgcacaaaataattttctaaataaaaaataaaaacattttctcagtcattaattcttaaaaagtatttctccccagtaattaatgtgaattaattcttaattcttaattatagaataatgttgcccttcagagttctgaatcttttgcacgttgtatacagtttactgactggaacatcttctggaatattggcattaattaatctcactcagcaattaatgatttcaaagaaattaaataccattcatattctgaatcacaagggtactttggcatctaatttaatcaagctctttgtatcatcatctacactttaattacttaacaaacatttctctgtgtgagaaagattgagcaggttattgtgcttttttatgatgcaacttttgcttaatctagagataggcaatgctccctataagggacaaagagaaaaatgaaagagcaatagagatgtgacaggcatggaaaaagacaatacatttataaaacaaatagggccacagatgatgataatggggatcaaatcttgagatactgactcagtttataaacgcactgtacaatagagcaaatcatttgttaattattttacaaatggaatctaatttaactaagatgaatacagtgttttaaacaaggcaggtcatcttaaaataaaatagtgggaaaagtgataaaaccaatgtaaaaatcataaacattttataaagaatttttgtcatgtaatttaatatttttctttatttaaaatcacccaaatcaaaataattttatcttaattaacaaataatcatcggaagttaactaatttttactttataatactaggtttaaaaattcttcactatatttttaatcatacatgcttatacataaaatagacatagggtatatgtttacatgttcacaatattatattgtaattgttcttatggatgtggtttttcaatagaattaataagtacttttaaaaagtttcaatttcaatgatatatatgtttgatttttctttgacaaagcatacatatattgataggtaataataagaaaatcttctaaagacattacaggaacatgaataagtaattaaatcctcaataatttgtaacgttttatgtaagcggaacacatttaactgaaaattgcttttatataatactcaaacgagactaaaaacatattaactagcggagtaagtcttcaaattgataatctgaactataaaagaggagaaacttcaagcactcaaatatttgaaatgctacaaaatatttatataaactattatttaacaatttctgtttgtagagtgctatagagtaatcgatgtaaatgacatctcagtctttctatagctttgaccacatttacctcctaattttaattattaatatgttggagcagtgcatacaactagattccgatcttcctttttaatgagtaaaaatatgtcctttgagacagcattaaagaaagagcaccttgtataaattcaatgccaagagacaagatattcttgatgctgaagtcttgttcttttatacagcaatgtaattaataagaagaagaaaagcaggacatagagatggagtctattttcatcaaaaattgtctatagattttgatgataaaatttaaaactctactatatttagttagtcacaaaaaacgaggttgtgggaacatatttggtcaataaaacacccctaccaaaagccgacaagaaaaaaagttaagtaccacctttcttctctgcagatggcctgagatgggttaatttgaaagaatgcttccaaacctgaggtgacccctgagaacagcataatccactgctgtctcccacattcagtttctcagtctgtgctcttttaattttggggggagggaagccagtcctttaaagcgatcttcagcatgatggcagagccaaggagtgtggacaggtggcacggtgtctgattttgttccagcagccacttgggctttctctgggtcttctctgccctcgggatagcactactattgaaaacatgtctttgtgacattctctatgccaggaactcccaacatattttccttgaaactgatgaaatgaaaaaaaataaaccaagaggtgtgctgtttgtttctgtttcctcctttctgcagcccttcttgatcatctaatatttttaaatacattgtcgatcaccaaaaggagcataagggctttattggtttgtagcagatgtattcatagcccagcccctattccttagctgtagctgctgggaagaaaaccattcttaacactctacaaggtctcatctccagaatttgcaccagtttctagctgaggactttctctagcagcacgggagcttgttactgggcatgaagtgggaagaaaaggtgagggtaactaagaagaatctccctggattcagtgatgtaattctgaggcatgctccacatagcttcccataaaattaagcccagatatctaacacagggacttacttcttaacacgtgtggtattggcttttctgtctttcctgttttattttgttctcttttccttgtctcactttcgctgtgtcctcactcctgctttaagaatacccaaacaaatacgttcatttatttttttagactctcagaacacagttgatagttgaacttgtaatctatgataatcagcttggatgctgtattgacaggaagatggtgaactcacaatgtctaattaagatacaatttaaaaaatatattgaatcatgtccaaagacttaaaaagcctaagcggcagcgtcacagtttcttctttttagtttgcatggtttcttaaatgcctacaattattttaaaggaagccttgagtctaggaaaaattgagacatatggaataaattactaacccatttctccttgaaatccattagatgtttgatgattcttcacatatatttctgaactgaaaagctagttgggaattatttttataagcatatccttatgtaatatattggttctaagagtgaatggaaggtttaaagattaaattattctatccagagaataaaaaacaattatttcacaaggagaacatgtgtatgttgacacgacattttaaaatctagattttaaaataggtcccatataattttgagtcaattagaatacgtttgtatcagtctgtctacagttttacacctgtcaaatgttacttgaactaaaagaagtaccttgaacaattttgaaatttattattcctctgaaactgatgaaaagaatgacggtagagtgaaatttggattggcataatttaggagagaaattattccttggagatcaacctctgccaagatagtttacaatgacattgatactttttgatttacacaatttgttatataaaaaatactaagacgatgacagataatacacagactttaattaaaattgtactaaaattaaaagtctaaataaattacaagtgtacgtggtacacctaaacgtatgtttatatattttatttgtgcattttattcctagggttccttttgctttagtttgtaaaacgttcttatttttatggcagtgtagtatatactaaataaagaaaaatcaggaaatagaaaatgaagaagaaaacattagctattgtcaaccaaataaaaattgtgcaatctctaagtacatgaacgatgtattatttgtacagcatgtacaatgtttatgcttcacagggtgaggtagagactgcaaaacattgaacctgggacaaataagaaagaaaggaaattttcacaatatattaatattacagaaaatgttgaacttaacagttaagatacaagtagtgaaaaatgatagtatttaaggagatctagaaaatgtcatccataccagtaatgtgtgagaagtattagaataatgcttgtatttctggattggcatcgatttctattgagactggaaacatactagaagtgagcaaaaaagaatttaaatagtggatacttgagttttatacctaggaattcgagaaatacattttgttactgtcaaagcagttggcacaagagtgtacaaaattccctaattgtgtctatgtggtgaagacatagacaaacagaaaatagcaaaacagaaatagcaaaaaagcacaaataaattttacctgtattttttacgtaaaagccaattagagtaggaaaacatgaaatttgtgttttatcgaaatttttctcttatagtatagttgattatattactggaaaaaaattgaagcattggtatgttcacaaaaaaaagtaaaagataaggtcaaaaccatgggaatgcagggagcagacaaaatacacctaaacactgatactgattttgccctacggacatgtagcaaaatgaatgagtgcagattcctatggtcatacatcacataggacagtaaagaaatacatagtgtttcccaagatagggcatcacacaggagctcttccctaaagctagcaccaaaatttatctcctcagtataaagaagaatcagaggtaaattagtctcatttcacattccctggaaatggcaaataaaaatgacttgagattggacagatttaaagaaactcaatcattaatgatttacagcaattaatttaaaaattgtttaaatgtgctgtccaaacatacgtccaaacacctttaggccaagaattaatataatgtggtcccagaatggtggtgcctttagtagactcacaaaaaattcaaattctctttggcaaattttcttcttactaatatgcaaaagtgcacaataataattttcagagaaaaataaatctttgtcattcaaaggcatctaagtacgcaaggaaatgatattccaccatttgaaaggaaagcagaaaaagagtacaaacagatccacagaggttcattagtagaaatatcactgttagattataaagcacatttgctttcaaaaaatttaaaaaaaggaatatatttttaggagactaaaaagttgatgtagtaaatttgaaaagtagtttgtatatagtattttaaattaaaaactcaaaaatgaactcatcagattagacatggccatggtgagagctcataaatatttcagaatgcattacagaaaatttaaaaaaaggcacaatgtggacagaatcatgaagagacatggaagatacagtgagaaagtgtagcatgtgtttagtgagtgttctcatagaggaagggaacggggaagggacaatatgtgatggtattttggctgaaagttctctagagttttgtaagacactaatccacatattcaaaacttctatgcatgctaagcaagctacgatggagataaacctacatctacatatctcctagagaaatagtaaacaatcaggaagggaaaaatatttcaattagcactagaaaaatcaaattacctttaatcatattgaaatctgaaagcatgaaaggtaaaataaacaatattatttgttaagaataataatgccattctgaaattctcaaccaagaaaaatattcatcaacctatggctaaatcacatatttagagacaaaaaacaaaacaccaccagcagaattccactaaagaaactcaaaggaaactctgaaaacacgcttcagaaagattgaagttctgaaatcaaagaatgaacacagagcaaaatatattgtaaacataaagatagatcaaaatagaaaattaggtgttgaaacaaaagaatatttaaaattaggtaagcactgcaatatgtatgttaggaagcaaattattagggctgaagtattcaaagaccccttaattgtctgacaagagcagaaaggtatgactttgcaattcttttttttttttttttttttttttttttttgagaaggagtctcattcaccctttctcccaggctggagtatggtggcgtcatctccgctcactgcaacctctgcctcccaggttcaagcaattctcctgcctcagcctcctgagtagcggggattacagccgcgtgccaccctgcctggctaatttttgtatttttagtagagacggggtttcaccatgttgatcaggctagtctccaactcctgacctcgtgatccacacgcctcggcctcccgaagtgttgagattacaggcgtgagccactgcgcgcgaccgactttggaactttaataaattgactggacattatgcatttctctgttgtatctatgaaaacaataaaaataaaagtcataattttaaaacaagaagacagaaagtgataggagaaaatgagacattatatatatatatatatatatatatatatatatatatatatatacacacacaacaaattactaatacaaaattaagtataaatgatcaaagattaacttaaacctaagtagacaatgtttttgttaaaatacaaagattggcaaaatttaaaacatccatctctatcatagttacaagagacacagctaatatataaatttacagaaactttgaagttcaaacaatacagatactgtgtatatatgatatacatacaaacacactacatgaatataattttttaaaaagttgctatgtagaccaaatagaagttagaaacatttattaaaataagttagtgtaaccagtgtgataaaagttttaagttattaagaagatgtgatgacttcaatgtgtattagcctgatacatacatatatatatacacacaaaccacacactctctctcacacacacagacacacacgtatttagagagagagtcaaattatataaagcaaaaatatcagaaagtaagtagaaatggataagcccccaaatattatagacatttcaaacacacgtctttcagtaatagataaaagaaaaaattaaaagagtaagttttaaaagaagctagtggattttaaaacgggcaaatattatataaggaacttgaatattataattcatgttattttcatgttcatacagaatacttacaaaaattaacattttctagaccataccacaaattcaaacaattttcacggaaataacgtgacacagaatatatgtcctaaacaaacagcaatgaaggcagatatcaatacaaaaacgaaagttagaaacataagtgtaataatattggttggaagccattttattgaatattgaaatattttaaaggtgaatagtcactacaaataaaccaaacacttttgtgaggccactaagatgcatgtgtaatgtgtaatgcctccttttataaggagtaaatctgtaacatcacctgggctatttgacaactgcaaagtgaatgtgagaaggagagaaacagtgagagagagagagataaaagcagtaaaataaacataaagaatgaaggagatagccaggcgccattgttcacgcctgtaatcccagcactttgggaggccgaggcaggtgggtcacctgaggtcaggagttcgagaccagcctggtctaacatggtgaaacccactctctactaaatatacaaaaattagcctggcatggtggcatgcatctgtaaccccagctactcgggaggctgaggtgggagaattgcttgaacgtggggtgtggaagttgcagtgagtagagatcacgcgactgcactccagcttgggcgacagagcaagactccgtgtcataaaaaaaaaaaacaaaaaacaagaaagaaaaaaacgaggaaatagtacacgaaaaagcagaattaaagcaactgggtatatatttaaaaatgcaaaagctcactttttcagaaaaatattaaaatattaaatctaacaaatatctaggtagactgatggagaaaaatacagaaaatgcacaaaaaagcaattacctggaatgcgaacgttacaaaacgtcagcagttgtagattttaaataagcaatgatttttgagttcaaccatgatggggtatattgaaaagaatctctcagaaaaaaagaaaaagaaaactgttataaagctatgtacaaaatgttaagcactattaaagtcttccaaatctaccagttacggagttattggtcttggactaacactcctgaaaagaaaaaaaacaaacaaaataagacaatacctaaaaacctggataaaatggcctaccgtgggcactggcaatgcatccaagcaggtaggacctgggtgctacattctctttgtcagaacacaaagcattcatacactcttctcaccctcactttcaccttttaatctttgatctactattaaatgtattcaacattactatcaatcctttgctcaaaatttctttactcacattttgcttgatgcacttggatagactgttcaagaaagtgtgagtagtgaattcctcaaactcttgcatattcaaaatcacatttttgaacctcgatgcttgaagtgtagcttgggtaacagatgggctttaagccaattttggcatgcaaggggttgagtttattaggcatcagcaccgctgaaaatcgtggggatgcaggcttaatttcaacactattctaaatacttgaaagatattatataagtctttaataaactcctgtgtctacaaatggttcacattaactcaatatccatgatgaaacatctataaaatcaaggcactgttatttagtggagacttgctggctattctatgagaggaggtattgttattgtaatctcatcatctcataaaattgtatcatattactcataaccagcccttcatattctattcctattttggtattttaaaataagatatctttgaaattcttgaattcaaagagggaatctgaatactttttaaaatgtcaatgaaatgccatttcttcatgcttcaacaactaaaaattgactaaagtgcttctcttcaatctttctgggacattttttatctaaattctaagaacaatcacaataggttttaaccacaaatgtgagaatattctaaatgttagggtggaaaaaatttttaaatattttatagtaatttttttcatcatagtgacagtgtgctaaatttttttaagccaactattactgtagacatttaagtcaggattctaagaagctgttctaaagtccaaaattcagtttcatatacactgatattatatatatatttgcttaaaaaattaatacatgtgagccgtgtttcaaatagttgagagattattatatcaaagattcttgattatataaaatgccaattacttataggcagacatgctttaaataattactaaggcagttgtggttgattctactcttgctactggcatttatatggacatactattatggtctgaagaatatttaggcaaatttatccctcatatgatcagaagaacaatgcaagatagtttatatctgaaaggaaaaaaatctttatatggttctgaaagcgtaaatcattaacaacttggataataattagcataaaaatacacaaacatgccctcttcctagcagtaagtacacagtgacaacagaatcaaagcatgtggctatgtgcatgtttatatttcaagacgcagagcactctattcctcctctctgccctttctagatggcacaatccctcatgaatctaagtgcagtcatagggtggattagggtgacctgccatttgtatgcaactgatctctagtttggaagtaattaatgtcaaaatatatttttaaaaggtaatttcaaatttcagggcaaactagcatggtttcgccccttttctttggaacattttttctaaggttggaaaagtaaggtaggctttagtacgattttaaataataagttttcaaagtgagacgcaaaatggtggcgccaacacatttcaaatctgctacattttgaagacacttattggagaaaagaccttctcatcatttttctcttacaggaaaggaaataacacgtacggttgacccttaagcaacacggaggttggggtgctggaccccctgcacggtagaaaatacactataactttgactcccccaaaacttaactactaatagcctactgtaagcctgacaaataacacagtcaattaacacatatttaatatgttatatgtcttatatactgtattcttaacaaacatgccagagaaaagaaaaaagaaaatcataaggaaaatagatttactagttattaaatggaagtagatgatcaaacaggtcttcatcctcatctttctcatgggcaggatgtggataaggatgtagaattgttggttttgctaagtggacgtgcacagttcaaacccctgtggtgcaaaggccaactgtatagccattgaatagcaatttatatttagaaattaacctcactaaaatactcttagaaagatgcccagaaaaaaagtgaataagaatttttggttcatctattacatcatttcatttcattatttcatttcttttcatcatttcatttcatttcctcatttcatcctttcatttcatcatttcatcatttcatctcatttcctcatttcatcctttcatttcatcatttcatcatttcatctcatttcctcatttcatcatttcatttcatccttccatttcatcatttcatcttatcatttcatctcattttatcatttcatttcattctttcatttcatttcatcatttcatctcaacatttcatttcatcatttcacttcatctcatcatttcatctcatcatttcatttcatctcaccatttcatttcatctcatcatttcatttcatctcatcatttcatcttttcatctcatcatttcatcatttcatttcatcttttcatctcatttcatttcatcaattcatcatttcatctcatcatttcatctcatttcatttcacttcatttctttgtttcatttcatcatttcatttcatcacttcatctcgacatttcatttcgtcatttcactttatctcatttcatcttttcatctcatgatttcatttcatctcatttcatttcatctcatttcatttcatctcatcatttcatttcatcttttcatctcatcatttcatcatttcatctcatttcatcatttcatttcatttatttcatcattgcatcatttgacttcatgtcatcatttcatatcatttcatcatttcatgttttcattcaatcatttcatcatttcacttattcatttcatttcatcttttcatttcctcatcatttcatttcatcctttcatcatttcatctcatcatttcatcctttcatttcattatttcatttcataatttcttctcattgttgcattttgtcattccatcatttcatcatttcacttcatctcatcatttcatcatctcacgatttcatctcatttcatctcgtttcatcttttcatctcgtcatttcatttcatctcatcttttcatctcatttcatttgatcatttcatcaattcatcatttcatcatttcatttcattatttcatcatttaatcatttaacttcatttcatcacttcatttcatttcatcatttcatatcatttcttcatttcaccatttgatcttctcatttcatttcatcatttcatcatttcacttcatttcatttcatcatttcatttcctcatttcatttcaccatttcatttcctcatttcatttcatcattccatttcatcatttcattacatttcatcatttcatcatttcacttcatatcatttcatcatttcatctcatgatttcatttcatctcatttcatcatttcacttcattctttcatttcatttcatcatttcatctcaacatttcatttcatttcatcatttcacttcatctcatcatttcatcatctcatgatttcatctcatcatttcatctcatttcatcttttcatctcgtcattacatttcatcatttcatttcatcttttcatctcgtcatttcatttgatcatttcatcaattcatcatttcatcatttcatttcatttcattatttcatcatttaatcatttaacttcatttcctcatttcatttcatttcatcatttcatatcatttcttcatttcaccatttgatcttttcatttcatttcatcattccatttcatttcctcatttcatttcacaatttcatttcatcatttcatttcatcattccatttcatcacatttcatcatttcatcatttcacttcatctcatcatttcatcatctcacgatttcatttcatctcatttcatcttttcatctcgtcatttcatttcatcatttcatttcatctcatcttttcatctcatttcatttgatcatttcatcaattcatcatttcatcatttcatttcattatttcatcatttaatcattcaacttcatttcatcacttcatttcatcatttcatatcatttcttcatttcaccatttgatcttctcatttcatttcatcatttcatcatttcacttcatttcatcatttcatttcatttcctcatttcatttcaccatttcatttcatcatttcatttcatcattccatttcatcatttcattacatttcatcatttcatcatttcacttcatctcatcatttcatcatttcatctcatgatttcatttcatctcatttcatcatttcatttcattctttcatttcatttcatcatttcatctcaacatttcatttcatttcatcatttcatttcatctcatcatttcatcatttcacttcatctcatcatttcatcatctcatgatttcatttcatctcatgatttcatctcatttcatcttttcatctcgtcattacatttcatcatttcatttcatcttttcatctcgtcatttcatttgatcatttcatcaattcatcatttcatttcatttcattatttcatcatttaatcatttaacttcatttcctcatttcatttcatttcatcatttcatatcatttcttcacttcaccgtttgatcttttcatttcatttcatcattccatttcatttcctcatttcatttcacaatttcatttcatcatttcatttcatcattccatttcatcacatttcatcatttcatcatttcacttcatctcatcatatcatctttcattgcattatttcatttcatctcatcatttcatttcatcatttcacttcatctcatcatttcatcacatcatttcatttcatctcatcatttcatttcatcttttcgtctcctcatttcatttaatcatttcgtttcttttcaccttttcatctcatcatttcatttcatcaattcatcatttaatttcattttttcgtcatttcatcattcacttcatttcatttcatcatttcatacatttcctcaattcatcatttcatcttttcatttcatttcatcatttcatcatttcatttcatttcacttcattatttcatttcatttcatttcaccattttatgtcatcatttcatttttcatcattccatttcatcatttcatttcatttcatcatcatttcagctcattatttcatttcttcatttcatcatttcgtttcatttcatcatttcatcatttcatttcatcatttcatcatatcatttcatttcagtgatacatgtatttaattgctaatgcgatgcccaggagacaccctatttccctttctaaaacacctccttcaacaaaaggcaacttctcatggctggctaagtctacagggatagcagcctctcctcaaccacccaatttcatttaaaacctcaaacagcacctcagtttcataaaaacctaaaacataaacacaacacttggttgtaagtgagccgacagtttcttgtctctttctctgctcaaggcttaaggctgtgtctccccaactacattcagtggaagagaagatcccatggacaaataagtttgagaattgttgttgcaggaattctcagaactttcaaaacacaaatcttcatccgcagggatcttcaggagggagatggctgatgcagcacaactttctttcagaggagtatcttgcagaatacagtatgagatacagaaaggctgcattgagtctttttaatggcccgggccttggtgagggtggggtaggagctctccagatagcatctaatgagtaggaacattcaggtggcttttttttttccttattcgcaaaactgtgtgtacaccatgaatgaagctggtctcccttatccacgtcaaaactaaacctaaattaattggctaaattgggactcaacacctccaggagccacgcggcagaaagccccaacacactttaaattagcttgcctcatcatatttgaggaaagcaaaacgcttatgaccagtatgctgctaatacaagtctacagataatgctgtatgaaaaactagttttcccaatcatagctggcatagtccacattttgcattacactttccccccctttttttaaattttaaacacaggtctttttctcttctttttttcaattttaattaaattatacaagacggagtctcagtatgttgcccaggctggtcttcaactcctgagctcaagcgatacaaccgtctccgcctcccaaagtgctgagattgcaggcctgagacactgtgcctggccttaaacacaaatcttaattcattcttacaattattctgaggttacaaaaatggaaggggaagaaaaatggcaagtaggtaggctgacttcggcttcattatttggaaggacagtttgctcggttaaaacacactactgcctacaaaggccaagacaacagaaaaatacagacttacataaatagattttatatgtgacagcagtttgaatggagactttttcaatgcaatgagaaacagctgtgcttgggaataaatgacaacgaattttttttatctcaacagctgtcctgagagcatgtctctacatctctacctgcattctggaatcagggagaaagccaaaacggacggcaagacactagatcagccgtgtccaaccctttgcctacaaggacttttccacctatctgtggtggtgggtagcatgaaaattatgcacaaacctttttttttttttaaccccatcagctgttttagcattagtgtattttatgtgcggcccaggagcattcttcttccaatgtggccctgagaagccaaaagactggacacctgtgcactagatcaaaaggccactccttctggaagcaattgtaaagaatttctgacattatcttgacatgaaaaccaatgggtagtgggacagaatgcaaaatcttgaagaatttttcttgtcttttttttttttttttttgagtcacggtcttgctctgtggcccaggctggagtacactggtgagatcagagctcagtgcaggatcaagtgctcctcccgcctcagccacagtagtagctgggactacagatgcgcacaaccacccctggctaatattttattttttgtagagatggggtctcactatattgtccaggttggtctcaaactccttgactcaagggatccaggaaaggataacaggtgggagccaccacacctggctatgtgcatgaacttttaagacaaacacaaggccccacaaaagttaaggtttttcccacctaatttccagggggatcttttggtgcaaggctgagaagcccttaaaagtacacagacaactccaaagattcaagacagttcatttgggctgagccagcccactgggcagactgaccttccaaaaagacccacccatgacatacaccagatggctctccaagaatctcttcagtcctcagggtccctaacgtactggacagagctaggaaagcaaacccatttgcttcttcctgcaggaaaccccttgaggttaagaccccacaatcacatgaggatggagtggctcaccctcagtcaacaggccagactcaaggtggtataatgtcttaaccacgggtgcgggcctccaggtctgactcccaactcagttcttctttaataaccacactttgttaattttccttaacaggggttcctggcaagtcatttctccctcaggccttcggtttcctcacctacaagatgagagggctggaccagatggaaattcagggggtaaggggatgtcctcacgcagcccacccccacccccacgggaccctggagcctccatcccagttcccaccacgcacccgctccacaaatcctgcccaaggtgagggctggtcctgggtcctctggctgccgcatcagcgagtgcaggagggaggggaagcctccaagggggtgacgtgggctcaaagatgcaactcggccaggagtgaactggggccccgaaggaggtgtccgggccgctcctggagcccagcccgggtccccgaaccccttacctccagggtctgtatctcctgctgggtgaggtcgttggacacagcgcacttggtgcacagcccgcacaggctgccaatgaagatgacgatgagcttctggagctgcccgcactgctgcagcgcccggctggccgcagcccctgtgccaccctccgtggccgccgcatcacccccaccaccgccctccttcttctctcccatcgcctccacaggcagcgccactctatgcaggccacaggggcctaggcaaggagcctggggcgccggcgcctaggcaaggaatccctgagccaggagagctggaccaggagcacccctcagagctgcccttgccaggacgccagtagagctggcagccgagtctgccgctcccgccctcagagccgtggcggcggggacaaaaatcctcggcggcgggggcaaaacgccgcggcggcgaaaaagtcgctgcggcagggggacaaaaagccgtgacagcggggcgcaaaaagccgcggcgggtaaaaggccgtggcgagtaaaaagccgcgatggcaaaaagccgcggtgggcaaaaagccacggcggcggtggggcaaaaagcagcggcggtggcggaggggcaaaaagccgtggcagcgagggggcagaaagccgcggcggcaaaaagccaaggcggcgagtgtgcaaaaagctgtgtcggcggtggggcaaaaagccgcggcggcgggtgtgtggcagaaagccgcggcgggcaaaaagccgcggcggcgaggggggcaaaaatccgcggcgggcaaaaagccgcggcggcgcggggtaaaaagccgcggtgggcaagaagccgaggcggggtggaggcaaaaagccgcggcggcgggtggcaaaaagctgcggcgggtaaaaggccgcgggggcaggggggaaaagccacggcggggaaaaagccgcggcggcggggtgcgaaaagcggcggggggcaaaacgcctcggcgggcaaaaagccgaggcagggtgggggcaaaaagctgcggcggcgggtgggtggcagaaagccgcggcggtgaggggggcacaaagccgcggcgggcaaaaagccgaggaggggtgggggcaaaaagccgcggcgggcaaaaagccgaggaggggtgggggcaaaaagctgcggcgggtgaaaagtcgcgggggcaggggggaaaaatccacggcgggaaaaagcggcggcggcgagggggcaaaaagccgcggggtgccaaaagcggcggggtgcaaaaggcggcggggggcaaaaagccgcagcggcggggggcgggcaaaaagccgcggcgacaaaactcgcaacggcgaggggtcaaaaagccggggcggactaaaagccctggcgccggggcggcgggggcgcaaaaagccgcagcggcgggtgggggcagaaagccgcagcggcgatggggcaaaaagccacggcggcgggggtaaaaagtcgctgcgggcaaaaagtcgcggcggcggggacaaaaaggcgcggcgggcaaaaagccgtggcgcaggggggacaaaaagccgcggcggggggtggggaagccacggcgggcaaaaagccgcggcggcgaggggcacaaagccccggcgggcaaaaacccgaggcggggtggggtctaaaagccgcggcggctgggggtaaaaagccgaggcgggtaaaaagccgtgggggcaggggggaaaaagccacggcggcgggggggcaaaaagcggaggggggcaaaatgccgcagcagcgggggacaaaaagccgcggcggcaaaattcgcagcggcgaggggtcaaaaagccgcggcgggctaaaagccctggcgccggggggcacaaagcagcggcgggcaaaaagcctaggcggggtggggggaataagccgcggcggcggggggggcgggaaaaagccgcggcggcgggggggcgggaaaaagccgcggcggtggcggcggagggcgaaataatggagatggagtggaaggccggcacagcttggcattgctggagtgcgatgtgataggaaatgtgcagccaaagacaaaaagatgtaagtaggcttgactcattgaagctaagaacccagatgttatcttgagggtattaactaataagcagtttaaatcagaatggcacattctgatttgtttcttgtacgttcatatttggcaggcatagatactgtttgaagagagaaaagtcagtagagagaggtaacaaacttaaatatgtgccaagtctagaaacaagagaccagggggatagggacctttcaaaataaaatgcaagatttgaaaactgattggctgggggatgaggaaaaggcaggtctttaaggtccatccctgttttgctttaagttgttagggggtggttttatcacatgttgtagaatatgtcatttcagttttgaacatcttgagttaaattgtcctagcatatcttatgaatttgattttcttccctggaaagctaatatttcaaacacttaaagagtatatagatttccaacttgtatccagtttataaaactatctctaggctgctgatttcaggaggaggcttatgagtattctccttgcagagaatatatcaggagttaacagcagcttcaatatttgtggatgaccggttaactaagccacctcttagtgtctttagttgggaaatcttagctgaagatattcaataatgaaccaagagtgactaagaaattcaatatttaagtatatttcattgtaattaatttgaattgaagtagccatatacagctagtatttactatattgaacaatgcaaataagaggaaaaaattaataaccatctctaataccacaggccaaaatcctcatcaatttattctagctaaaggagttgatcagaagcagtagttgaaagcaccaactaaacccagctggggttagttcactgtcattctctcagaaccgtctcttctctgaacaaaacaagtacaagagttcattgtgaatctgcattctccttgcctattttaaggttttgatgttgacgcaaatttgtgaaatccctcctgtggtgtgatatttcgttttccttgctttgtgttaggacaagaatgcttcagctcttaatttaaaattatgtttctccctcctaggttgagtgaacttagaatgcattctctgacatatccaagattttgttaatatgaatttcgggaaaaaagcatacttaattagctaagacgtcttattctaagcttgaccctatgttcgacatcttttgaatttctggttgcgtgggctgctctctgacactggttagtgacctggaagctctattaatgttaggggaggtggtgtatgagcattagaggtatccttgcaaggaaagacttgtcttatctcaatacgtctttttttttgcacacaagaaagtcaatgtctgagtcttctaaaatcttcctatttccaaattgcagattatgattgattcctaaacaaagacctaatttttgactcagagacgtggcaagctagtgaatcaccgttataatttaacaatcttcaagataaaattatctctgatatttagattttgcccaattattaagatatttgggtgtttcgttaagaatggaaaactctagtctcttgagcagagactataaaggcctcagatgatcatttttaattttatgctcttttctttaacaccttcaacacagttggaagcagccgatattccgcagagttgttgtgttttttaaaccaaatgcatggttcagtggtagaaaactgggctgatccaagctgttttcagtaaacacttcatttcaggtgacccatttcgtattaaataatctctagatcctgtcttcgaaactaactagatcagataaactaccctggattttctctttttagggtctgagagctgcagtcacttttgtgaaaatgattacaatgacaagatagagttgtagatggggaaaatgttttgactaatttaagcatagtggtatttcatatgagaatttaagttacacacatttgaaaattataatggagtctcttggctgagctttaaaaagaaatagcgtttaggctaaaaagggaactgctacctctcctaaaatcagaaagatgttacagtaattctccattctctagaattatcaagaagcacctttgtgatgatttacttttgctcttgcgactgtgagcccgtgtagtcgtggaaccatcaattagaatggttgctttctgatcccaaagtcactcgttctgaaaacaatatttttcataaatttgaaagtgagaagttttgatcttgccattcccaagtaactctcttaataagaggcatcagcatgcttcagtgacagctgtcaccttccattgctgagagtcatctttgagttctctatttcactccctacactccaatttagctgcagttctcttggccagtcctatgaaatacatccatggcctaacaacttctcaccactactaccactcatgctgacagcattctcacctaagtcactaccttttttcactggattagagtagcctcccaatttatttgctcacataacctatttattctacacagtgcaccagatacacccctttgaaatgcaaacacaatcatattattctctggtgaaattatctcatatattcctatcgcatttaaaattaattcagaatcatcccatgattatcaaaaccctacatgctcttccacaacatggtttacttccaagatatctcttcaacatttttttcactgtactgaattggtgactaatagtcatatttttgtttttgctcaaaaagtcttgacttgtaaatttttcagtttctcctttatccacaggtaactctttcctgataaggcgaattgcttgcttccttgaattctgctctcaaagatacccttcactttctacctaatattaataactttaatcattcattattccattactatgctctatggtgtatacaatttctgttctttgtcatgttattaactaaattatttattgggtccagtaacgtattccataaatattgtacacataaaaattgtgttatttttattcctgtatgctgagctgcccaataacagtctgaggattaacatatttgttaaatgcacaaatacattctttcacaaatattagtttaataattttatattaaactccctctatacttacaatatgaattagataattcagaataaacattccattggaaaaagctacacaatttgttataaaacatccttaaaagcatcagaaaattaatacagcaatgaagaattacaggaccaaattaagaatggtatgaaagcctgtttgtgacgcttatgtttgggttatctctttatttgagtgactataaatctcaaaagagaactaaagggagaaataaccgtatctactaacatgctaagggtacttaaacatctcttagtaattgagaaaattgaaagaaaagaaaaaagagaaagggagaaagagaaacagcgaaagggataatgaaggagagaaagaagaagagaaaggaagaggaagaaaagtaaaaaggaggaggagggggaaggaagaaggcacaatcacagctcactgcagtctcgaccttccaggctcaaatgatcctcccacctcagcatcccaagtagctcacactacaggcacccaccaccacaccaagctaatttttattttttttgtagagatggagtctcactatattgcccaggctggtcttgaactactgtagtcaagtggtcctcccacctgagcctcccaaagtgctgggattacaagcataagccaccatacttggtgagatatgaatttctaggaaaaaaatcaaaattgactcaaaaagtagaaaaaaaacttacatagattaaatatattgaatcagtaatgaaaaaacttcccataaagaaatttccaggcccaagtgccttcaccaaaaagttccatgaaacatacaagagaaacaaaccaaccaaccaaacaacaacaacaaaaaaaactctgccaccaacacagagaataaaaaaagaagactcccgagttcattttacaaggttaaaataaaaataaccttgatatcaaaacccaacaaggcaagtgcaagagaaaatatttacaggccatcattattcaacgtggatcagcaattatttttaagatgtactggccaggtgtggtggtcatgcctataatcctagtattttgggaggcccgagtgagaggatggcctgagctcaggagtttgagaccagcctgggcaacaaggcaaaatcacgtctttataaaaaatacaaaaattagctgggcatggcagcacacctgtagacccagctattcgggaggctgaggtgggaggatcacttgagcctagcaggttgagaatgcagtgatccctgatcatgccactgtgctccagcctgggcaacagagtgagaccctgtctcaaaacaacaacagaaagatatgctgaccgcctgtgatgctggccaggatggcgtatgcatgctacggcctgtcatttccactgatcacaatttgaaactctggacaaaatataaatagcaatgacccaagtactctgaaaagtaaccagcagacaggttgggaaacgtcaaaacctgaagaattatctggatggtggtggtgagagatcatattctgggtcataaaacaaaccctaaagttaaacaattaaaattcagtgaattattttctctgatgacagaattaaactaggaatctagaacatttctagaacatccccaaatatgagaagttaaatggcatacttctaaatggcccataggtcaaagagagtatcttaagacaaattggaaaacagtttgaacttaataaatatgacatcatcttatcaaaatatgtgcttacagggcaatttatggcactaaattatgagaaatgaagcatcaaatcaataatgtaagcatttactttaagtaaaaaaagaaccaaataaactcaaatcaggcataagaaaaacagactaaatcagtaatatttaaacaaaaacagtaaaggaaaaaaattcaacgaaatccaaagttggttctttgcaagggcggtgggaggtggaagtcaatcaaatgaggaagcctctagcagactgacaaaggaagaagagaaaacacaaattgccaataccagaaatgaaaggaatattattacaaatcctgtagacactagaaggctagaatggacactacaaaaacaaaacaaacaactatatgcttctaaattctacaaattaggtgaaatagatcaattccttgaaagacagactaccgaaactcaagaagaaacagacagcttgaatacccctgtatttattaaagaaacagaagtggcacagcactttggaagacaatttggcaggttctgataaagtcaaacgtacatggaccatgtgactcggcaatcctacccttaggcatttgcacaagtgaaatgaaaacctatgctcagacaaaaagcactttgtgaattccaatccacttataatttatcaaaaagtgaaaatagtccatattcctccaatgacaaaccaataagcaaaccatgtagtatttatacaatggattactatttggcaattaaaaggaataactgttgatacagtatatgaaagtagccagactcaaaaggctacatcctgaacgattccatttgtataaaattctgaaaaaaaagcaatgccagaggaacacagatcagttattgccagaagtttacaatggaaggttttactataaagggtaaggtaatttttggagtgatcatataattttgtaatctaccaaaaacaaacataataaatgggcagataagtaaagttcatggattggaaagttcaatattgcaaagttctcccaaaaatgacctatcaatttaatcccagtggaaattccaatcagttttgtgaaggctgctaagtcaactctaaaatggccaagaatagacaagatcaccggagaggaagcagggaggtggacacaaatatcttctgattgatgagtgaaatcattagaaggccagcaaaaatacaagtaagccagaatttctaaagcaccacaaaagaacactagttagtagtgcataaaggtatctcctaaatttgttgtaaacataggcctttaaaaaaatattagaaactgatatttaaagagatataaactcatattaagcttttaaaaaattctaagcaagggcctcacctaatttcataaaaggttgcgtagaaccaaccattgctgcaaacgatgtgctgccctgagatgtgaggatcccagtggtccctctgggtcaacagcagctaccgcaggtgagcccaaattctgatacattatctatctacaatcattatttttaacaatgtatatcaatgctacccataaggcacagagaagcagaaatgtttatgtggcctcctgccaaaaacaatcacttgcacttatttctagtactccagaagacagtaatagaagtttttcaatttagaaaaacatttacagcaaagaaaaaaatctctgtaaacttcctgcttatccaatctagtgaattgtgatgagccatataaattcatttagccaccttatgaaagacttaatccaaagtcacttctaacttctagaagagctaatgtattataatcacagttgtgaaagactcaaaggccagaaatgtcaaggtgtggtctatatcctaagtccagaaaaaaaaacaaaaagcaacacgtacaggccaaatgattgccaatttcttctgcctacgtcatctttcttcactatagcctgaaattacatttcatgtttgacaattctcagcaaggagacaaaacaagcttatgagtaaaataatagaaagcagagccacagagaggacgagaggcaggagtcatctcccaagtccaagttcaacttctatattattagacaaggcctcagtgtctttgaactgcaaggaattaatattgattgtagcatgagtaaaatctatcttctactcatcatgaaaagtcacagtcgttttgtttaaagactccagaattattataggcagaaacaagcaggttccacacctatttggtgaaacgaggaatcaggaatgagcattcccaagagaatacaattacaaaagtaaaatcacctagagtttttgggctgcttaaaaaacccagaaagaagtgccaaatgggaaaataatcaaattcagtggaaaaactcacttgaaggtatcatggtcagctgggtttccacccctttgttgcacttcaaatcctgtgtattccacaaagacttgctcctttctaaaggctatggttcacattcaacagaatagcagcaaccaccatgagcctgagggctggctagtctttagtattctgccttattcaaagaaaggatcatttccctcattcctaaagatctcccaggtccatcacaaaaaaaaaaaggagcagcagccaggcgcaatggctcacacctgtaatcccagcactttgagaggccaaggggggagggtcacctgaggtcgagagttcaagaccagcctggccaacatgatgaaactaaaaatacaaaaatcagccgggtgtggtggtgtgtgcctgtaatcccagctactttggagctgggtaactggcagaggttgaacaatttgcaggtctcagaagacaggaaaatgtgggaaagtttgaaattccaagagacttgttgaatggctttgaccaaaatgctgataatgatatggacaatgaaatccatgctgaggcagtctctgatggagatgaggaacttgctgggaactggagcaaaggtgactcttgtcacctttgataagatggtggttgaggagaggtcttggcaagcagtgatgtgtgaatgtagtgaggggcctgaaaatggaactcagagaggacactgggttttagaggctgaaactacagaaagtccgctgcgttcaaggcctgcttccaccaaaatctagcagtgtggcctcaaaccatttcatttctcttggcctcagtttctacatctgcaaaatgggatttataatcccaccccagcccacagaattcagagttatatgagaaggctagaagagctcacctaccaagggactcttttaatggcaaggtggggaaactgaggcaccgagagggctagggctctgctagctgtcacccagagtctgatggacctgagatgagaaaccagaactcctgcccctagttcccccggctttcctcaggctggggagtgagtgcggtgagatagaaagggcaagccctcctgctgtttctctctggacaggggcgggatgctgggtgaagggtgaaaggaagaggctggagaagggagaaaagctccagctcacactaagtctgaattttttttaaatgcggactccgtggcccctcccttacccgccccaatcctctctgaagtcctggttgtgaggggccaagtcccaaagtctgctgctccgcctctctgtgtgcagagccatggggccttcacaggctgcagtgggtcccgagcccccagggctgtgcctgctggtcctgaccaagatcgcggctgccgaggtcagtccagcgccaagggcacagggccagggcaggcggggcagggctacccgaagcgcatagaggctgctggtgtcaacgtgacgtcttctggggcgcctggcatccctaggagtggaagccgctgatgaagtcaaagctgcctcctccttcaggaagactttgctcccatagctggcgaacaggaagcggagcagcgccaggaggatctgcgggcgctgctgagggcttctttgcagggacagtgcagcaggcagccagggacaagactgcacggcagcgccccatggccaggggaagctcagaaccggagtcgcccgctgcccggcgattctccatccctggatcggtacaggggcatttggacgctgtggggaagtcgcggtctggggatattgggtccagccttcgggtagaagcaggtgataaacgcactcaggccagcccggagcgtcagccacactgcggtgcccacgatgcccagggtgagcgccacgaggcgcaggaaattggctagggtgggagctcactggtaggcggccctggaagtcaaagatctgctgctccagcgctgccaccagttgcaggcagcagaaggcgaggagcgtgtggcacccgcgtactcgcccatcgctccgcggacctctttatccaaccttcaataattattctttttattatattcaatgattattctacttttcatagagagcagctgtcagtccaataacacacttaacaaatgatatacctagtcctcaaggttaacaaacacatgaagaccagcccaaccctgaaaatcagtttgcaaaccttcgctatatctgatgccattcctaaaaatttttagggacaagttttgtttgtggtaaacaacataaggtggggtgtgtgctgagcccaaagctgaccaattgctcacaattactcataactacccattgacttgattttatcaaacttcagacagtcttgtctcctctcctcaggcccctggaccttggctcaccacctaagactgaacaagcactaaaggacagaccagcccgctaacagctcactccaaaaatgagcgggactcccagagaaactatttttattggagcatcctggttttgccacctgctcaccccactgcctgttcttctctccaaggaggcttctgccagccctgcttgtccttccctagaaaaggaaagccttttcctgtttgatcctgagacacctgtagattgagtttggaatattctccctattgcaatagtatttttgaataagttttatttttccctacctctggttgatttttaattaataccagtaagcttggatgaaagcctgcacaccttaggtgtgtgtgtgtgtgtgtatgtatgtactttagcattatcataaagtaataacagtaaaatcaaacaaacacagatggataagcaatatgttggactagtatgaaaatggcattgccagcagtgatatgatttttttttcaaaatggtacactttttgaagtataatcttattttaacctaaaatcttactatcagaaaatgcagtgtacattaaaatgttctgaactgcttttattcatatattaaatggttgtactcaaatatctacaaatttgtttttcacttatgtaattgtcttatagaatgttcaaaagtcttgcagaatgtgagacaattttctattgaatacgatcgctttatcattgcaagacatcaaacatccctgtttcctgccaaataaatgtacaatagcaataaatgtaaagatgtgttttgtaaaaaagatatatttttgagttacaaaacaaggattttaaaacttgaattgttacagtgaatatgtcttaatacaggccagagtcatttaggtaaaaaattacctcatatctattctttacagtatcacttaaaggtgtttatttagcggcaaagatttttttttttttgtgcctagaggcagatattttgccccatggctatttacggtatgaaactgtatttaaatgagtgtacatacataaaagctgccattctggctgtaaactattgcaggttatcaagattaaaaaataaacaaataaaaatatttcagtttttctatgaaatgtctttactcgagtccaaatgtagagatataaaatgcttgaaattcataaaaccaagtgtttcacatatttcagttgtgatggcctttgtcctacttttgttagtgaagcaggcagactgcattttttccctctcatacatcttcaaatggtagacagaaaaatttgataaaacttctagggcattatctgatgaaacacattaaacactaaaggagaaatacaacttcattgtttataaaagacgtataagaaggaaacctgcatacatatatctatcagttttgtattttcaagaaatatttgccttaaaatgaacttcattagaatatgtgttctcccacagagccaaggaaagtaagttagacacaggatctggaagtctacctgtgtgatgtaattacattgaaaacattccacaaataatgcagaaatgtatcattgtgacccaaaatattctctaaattttctcaaagcaatgtggccacatctattatcttttactatgactagtcatcattccatgcatttgaacattacctcacccatttgcagcctcctatctctgcaattaattatggctaacattctcagcagtccaaacatcttgcaagtgacagcttgaaaaggcctaccagaatgatgttcactctgccacctgactagcttgtcttccatctagacattgcagtatgtagaagagtgcttttagtattataaatttgatccaacacgtgttcaattagatgaaatcttaaatactgcactacatgtgaattgggaaaatgttaatttgcttctgtagttttaagtgtattctcagaggcagatgaagacatattacatcactgagttcaagaaataaagtaaatagaagaaaaaaggtgttattttagtttggttatgtttatatttgaagttttcttatcataccttattttttgtttattaattccagggtagagtagaaaaatatgctctcatataatataaaaatgatatggggaaaagaagtaaaaaattaacttagagacaccattaattaatttcttttataaatgaaacactagatagtttctatttgttttgacaaatagataatatatttagaatcaatgctttatttcttggaaagtggagtgaaaaatttaaatgtagtattcagattgtattataactgtgcactacagatcacatacatttgtcttttctttgtattatacattatttaatggtaagcatcctttcaagggctattttatataagtagtaaggtatctggaatttctgaaataataaaagtgacctaaatcactgtgtttggtaaattcacaatacccaaatagcaggaggggagtgctagaggtagggaggagaatgctcatgttctcattattcccaaacagattcttaaagtcttctcactggacacatggatgcacctctgtaatacccaatgtcttagccacaactgtccgcactttttaatgagatacatttcaacattattccttgtcacctcaatatcagatactttctcatgtaatcttttacttctgaggagttgaattcttgatccataaactgaatccatagctatgcatctgtggatgtttttaaattatgtgaaaattttgtatatgcatttttcaggggaaagtatcagatcacccacctggtgattgtaacaaaaacaatcactcctgttggtatttaagtcttaattaattcagaaaaatttgcacacaccctaaggtcagatagtattttgtaccctacatataaaaactccttttttttttttttgagatggagtctcactctgttgcccaggttggagtgcactggcatgatctctgctcactgcaaactctgcctcccataacattaatgatcactgatcacagatcaccgtaacgaatataataataaggaaatattttaaaaattgtgaagattaccaaagtgtgaaaccaagacacaaagtgagcacaggctgtttgttaaatggcaccaatagacttgcttcaccagggttgtcacaaacatctcatttgtaaataaagaaaaaatgttcctatctgtgaagcacaataaagagaagtgcaataaaatatgtttgtattaatttggttaactttattccaacttaatgtaaattagttttaaaacagtttataaaattcttaaatgaacctggcaaatttagagcaataataaaattatttaaattagaaaagtcttttttaaaaaggataaataacaaatgtctcattggaattattaaagttgtttcaagttcagctctgaggttcttagaaactaaagtaaaaaagtatgaccagtttctgaagtcaagataaaatcatacaatctttaacttagaaaattatcttctgtgttgtgtcctaagcataaacaaatgtaaggacttgccctgacactctgtaagtagttccactccaatacgccctgcagaaatatttcctggcaagaacagcaagtcagaagccttttcagcatggcaaggagggagagagactatgctattaaaaaaaaaaaaaaaaaaaagatgaggaggaacaatagcaccttagacaagtgagaagtttcaaaagagacatataaggagagcagttgcaattataaggagcaaaatatggaatgatgaaaaaaagatactttaaagaaagttttcctcagtactttgcaatgcgcttgccaccttctgaagaaagctggctccttctggaaccttagggtatttggactcatgctttggaatggggtgaccatctacatcaagctaacttaaattcaaatttgtgtgcataggataagaataattgggttaaataaaattcacttttaatctaaaatgtcattcattagttttgaccaactttccttaccactggccacttggtccttgtcttgtttgaccagggttgtcaaacaaggtttgttgtttccttctttgaaggaaagagtcagtgtttcttccattccaatgcatccacttgaggaatttttaataaaatgggcaatgaatgggcagcagaagaagttacaggcctgctgatcaaatgctaagtaataaaccctggaaattctaaactcgtttgcatgaagaccttgcttattttgtaactattatgtattatcaaatgtatacttaattctttgaatgtgttagtatgtgttcaaagtacaccttaattttatatatatatatatttaaattacataaaataaataagccactaaaaatttttaaacattttcttatatttcctttcagtatttttatgtgcatgcatctgtacttggtaatattgctgaatgcatgtttgcattgacaaagcctctccccttgcccaaactctagttgggatcctctaagccacctctcagcctcagctttcagtgttcatcctagtctggcccacatctctcaggtttaggaagaaacttgcaaagaatcccccactctcagtactgatcacctttgatatctgatcaaatttgttatctcccaccaccctccagatgatttctgatcagtctggcctgccttcagtaagaatcctgttcgatctgtttaacccaaatcccctttgcccctgatatttcctcttagtatccccagttgagccaattttcaaccattaaaaaaatcttggacaaaattaagttcagataggttccagagtgcttatgttcagttcttggctttttgaagacctggcatatcctctttaaattgcctcaatacaagaaaatacaaaatggaaagaagtagacattagaaattggaaaaatggagaaatacaggaatgaacataagtttctatttcaagtaattaggtaaattgtaagatgtttatatttaactttttctcattggctttagccccttgaatctttgagaacatgttattactatagttatcgaatgttatattttttattttaacgtagaatggtattttcactcaaatctcttgaaacatatatttatagtcaatagttaaattttatttaatatcaattgttcctttttattagtattttcttaaaaaaataatattggcccagcgcagtggttcacacctgtaatcccagcactttgggaggctaaggtgggcagatcacttgaggtcgggagttggagaccagcctgagcaacttggagacaacctttctctactaaaaatacaaaaattagccggacgtggtggtgcatgcctgtaatcccagctactcaggaggctcgaggcaagagaattgcttgaacctgggaggtagaggttgcagtgagccgagatcgcaccaccgcactctagcctgggtgacagagcgagactccatctcaaaaaaaaagaaagaaagaaaatgccagacatttattgaagggctggaatggtatagtgaagtgttctgagtcagttgggctctgattgataaagagcttggcatgtttgaaggacagcaaggaagccagaatagctggagcatagcagcagggagacaagtgccacaagatgagctggagaaaggcactgggaaaggtttgtcttttaagtgctctgagaagcaattgaagatttgaaatagaatagtgacttgcttgatcacatttgtacttttgaaaagttcctctggctgctgtggggaaaggcttgagtagatgcagggtgggagaagcataaccagcagtagactcttgtagcaggttaggtgagagatggtggtggccacgagtgggctgctagtggtggaagtgacaagaagcagaaggatcggagacaaaacttgaagataaaaagtcttgaatttgctgatgatttgcattgacgaggtgttgggggagaggactgaaggagcagaggagagtgacaagggactggatgccatttataaggatggggaagactgggatgaaaccggttaagggagaaattttaaccatggcaaaattaagaggggttttatgtgagaaaatggaaatgctaaggaggaagttgaaaatcctgctaatttggagatctttgattaaaactagaaataagaatgtgggaagcatcaacttgcaagatgccctcattgtagataacaccatttaggatctaggctcaagccctgggaaactccagggctttggaagtcaaatagaggaagaacacgtacaggagatgaagaaagattagcgaggaagtcagtgaaatatccacaggtgggctgctgccaaatccagcagaacagtatgccagatgttaggagcatgagtaaaatgagaaaagagaaatggcttttgacaacacttccctactaatagtagggaagaagacataggtacagattcaagttgatttgaaattatgaaagtgaggtaattgacctgcagtggttgctgctcagtgaaatcagcatagtgattacctgagctaggttagagatttgatgggtaagaaagaacacctgagggtaatcctggagggggaaaaaaataaagtgtttgctggagagaatgagttggattgctggacttcaatgtgtgtgggttgagtttgtgacttaaaaatgaaaccagtctattgcttgtgtggcttttccaaaataccgttattccgttacctatctcttaccccaagagtagtcacattcttatttctggttattttaattcctggtggtatttttatgtgattaatgagatagtacttgttaatttgatgatattctagaaacctggtaagtactatgtaccttgtcttaagttttggttacttgattggtaaaattatgcatgcaccattgaattacctaattcaaaatatatccttttattgtttgacatttgtcttgtttttctttaaaatgttatctttgtggagtaaacatttttctttatgctgtttagcatcttcagattagttcagggtattgctgaatgtggttgtttggaagtaaaatgctttagttttagttatatagattttaataagatactactttctatataatttatcaggtactttaggcattttaatttgcaaatttaggacaatttgctttaacgtttcttcacttttgtccattggatgtaatttccataaagtattcatttccctgagtaaaaaccgaaaccaaaccggcaactaatggtcactgaagaaagagtgattaaatgctaagattataatggtatttgcattttaatgttaccagctctctacagtgtaaagtttatgcatttatctattgcttatgtttctcattgcattctttggcctactggttttggttgtttatagctatagaatatagaattccttatggttatccatttctccttttaagtagagtgatagttgttagaagaaaaataaccccccaatactttcttctagtgttaattcttaaagtgtgattgacttttatttactttttggtgcagtaattgcagttcatgagtcaatgttgatgtcatataaaccttaatttttaatgtttcattgtagtgatgtctctgtagcagcaaacatttaagttatttgttatacttaaatgtttaaatcactgttagtgattagcttattttgccttccttgaagcaatttgtcctaaatttccatatgtttgcatttgtttttgctgttctaaaattccttagttgctggctttgaccttttatgttgctgagttttacacatctattttctcaactgccatatcctaggaggcttggagtacccataatacagtgagcccaccttcctggtccccagacatttcaggaggtcgggaaatttttaaacccaggcagcttcctggcagtgccatttggagcatcaaagtggtaaataaaattgcatttacattcatatatcatttctgtctgatttgttttgccctactgggtgtaaagaattaaatctttcttttctagattgagcttccagaaacactttttaaatctaaaaattttaatgtaaagaaataatatgcttgcatttaaaaatcaatatacatttttaatacctctttttatggttaattccttttgttgtgattactaccggttttatgagggagaagtccttgacatgtagaccaaaaggtaattaaggaccttttcattcatgatatcataaaactttgttgcttagaaaaaagcaaaagaaaaaactccattaatttattatgttcttatggagaagaaataccaaaattgtggcagatttcattgtctgtttaataccttaaaatgacaaggctttttcccccatgacattggttgatggctgtgccagtccttgaagtgagttaagtagtgtgatgcattttgaagagaaaaaaattaatttgaaaaagtattaactcaaaagttaaaatacttcattgactggagatgacagtttttcttcatattctatatttaatattctggaatatggctgtttaattcagactaatcaaggattttaaggaattctagattatactttattttctttcatgactggaagtactatttttttttaacctccctacctccccctgatatcatccaagatattgaggtataaatatacctcatttgacagtttgataatatagaccaccaatttttacttaccttttttctgggtcagcatttcatgtttgagaaaagaaattgagagattactgtagtcttgatttttaatcactgacttaatttttcaaaaatcttttataccagcttaataacaaaacaaactcggccgggcgcagtggctcacgcctgtaatcccagcactttgggaggctgagggggcagatcaccggaggtcaggagttcgaggccaacctggccaaagtggtgaaaccccgtctctactaaaaatacaaagagatttagccgtgcgtggtggcatgtgcctgtaatcccagctgctagggaggctgaggcaggagaattgcttgaacccaggagatggaggttgcagtgagccaagatcacatcattgcactccagcctgggcaaagaagcgagactccatctcaaaaacaaacaaacaaacaaaaaacccaaaaaactaacctgaccccatctatctgttgtgcaaagaagctgatgcacttctcaaaagggatctcaaggagagcagggtaagagaagacaggagtggcagtttgaaactgggagctggctgtatttattacatccaaagggaaaaaagccattcctcccattccttttgttcatgtgtttctattttatgcttacagtatcatcataaatttttgacttggaaaccattctgctaaatagggaatcagtttatttcaaactatgataagggacatcagttgaagatatgacatattatttaacttatggtgagggaaacacctaagtattttcctgagcatctggataattttaaatacacataattcatctacttaggtaggtgccaggttttttcaaggagtaattaattagtacgaacaagggtgagggggcagggaacaccatactctggtacttaatgtctgaaattatcagggaatttaacacattttcccataggtttatttcttgtgtaagaagtcagataaattatttccatttcaagtatttattattcagattatttaaagcaaagctttcacaaagccttttgtcagctttcctgtaatcctcaaataatttttcctggctggacgctttggcttactcctgtaatcctggcactttgggaggcagaagcaggaggatcacttgagcccaagagttctaggctgcagtgagctgtgatcacaccactgcactccaacctgagtgacggatcaagttcttgtctcaaaaataaaagtaataacaataataataaattttcctctaaatacaatggtgaatgaggtagaaatgttgagttcataagagaactgttgaatagtgaaggaaactgacttaattttaatgacaggaagaatactgttacacactagcaaaaataaactttcatgctgatgtagcagtacagaatatgcttccaacccagggacgctggagccaggcttgctagctaagcgaccttggacaagttacttaaccattttattcctcagcacactcatctcaaacgaggataataaaacctactatatgggattgttgagagtaaaaaatacttagattagtacatagtaagtactcaatagatgttagctattactgtaatcaccgcgagaccagttaatgagagagttcttccttatccttactctatattgaatacaatttgttgcacttcgaaatatctggataaggctatagttgttgtcgtcaccgagaatgtaggagtggcaaagagaaaaatcatgcaaaggcttgctgatagcgttcacagtgacagcccgaaagtatgattctaaggttgtaagcattttatatttagaattttaagttgtggaatatacttttaaagataaaaataataagccaggtctcttaatacttatctaaagaagtgtttgtataacatttaataaaatgttttatctcagtggcatttggatttaaaaattattttgggctgtcacagaatgttgacttttcctaatctgttacatagggccatgggtctggatttccaggaaagcggagacctcgaggtgcaggactgtcggggcgaggtggccgaggcaggtcaaagctgaaaagtggaatcggagctgttgtattgcctggggtgaggcttgcttcatgtatattttctctaatctaaatgtcagttaatgatgaaaatctcatagcaagttattttgaacttaaaaatcatataaataggtcaaaatgtttattttactgtcctactttgctttttttttttttttttgagcctctggttacgttttcttgtatatttactttctcatcctttctcttttcttaccttcctctttgactccttatctttctatgccaaccctctctaaaaagtcagtatgtaatatagttgctcttttatttaaaaaattttaagattgatatttgcttactatcatgttacgaggctttatttatatgtgtattacaaatatatttgttaactactagcaaatattttatgtaataacttcgctattttattaaaatcctgtttttaaaattctgaaatgtcattttaagtataggagacaggtgaaattgttcaagtttactactaaaccaggaataaggaagcttagattcttgtccttttttcaaaaagaaaaattttaaaaccaggcttattgaggtatagttgatataagctatatttgacatgtacaattccataagctttgatatatacatatacacccttgaaaacgataccacaatcatgatagtgaatatattcatctcccaacgtttcttcatgtccctctgtaattttctgcattccccctgccatccgtccttgtccccaagattagtttgcattttctagagttgtatataagtggaatcatacagaactgtgtgctttttggactgatttatttcagcacaattatttggagattaatctatgctgttgtacttgttaacagtgtacttccttttcttgctgaatattaataaaactgtggatgcaccacggttgtagacctgtgcactttttttcttctttttttttttttttttttttctgagacaggttctcgttctaattcctggctggagtgcagtggtgcgatcatagctaactccagctttgacctcccacctctgtctcacaagtagctgggaccatagctgtgtgccaacacacccaactacttttttaaaatttttaatagagacagcatctcactatgttgtccaggctggtctcgaacttctgagctcaagcaattttcccaccttggcttcccaaaatgctgggattacaggcgtgagtcaccatgccccagcctgtagtcttaatttcttgtaatgtcttcatctggttttggtatcagcataactccagcttcatagaatgaatcagaaagtatattctcatcttcagttttctggaaaagttgtgtagtagtggaaatgtatcttcttatattatacatgaatttattagtgaaaccatcttggcctgaaattttctttgtggggggtttttgttgtgttttctttttttttttcttctttcttttgagatggagtttcgctcttgttgcctaggctggagtgcaatggcacaatctcagctcatgcaaccactgcctcccaggttcaagtgattcccctgcctcagccccctgggtagctgggattacatgtgcctgccaccatgcctggctatttttttttttttttttttttttgtatttttagtagagacagtttttcaccatgttggccaggctggtctcgaactcctgacctcatgtgatccacctgccttggcctcccaaagtgttgggattacaggcatgagccaccatgcccaggctggagtgcagtggcgtgatctctgctcactacagcctccacctcccaggttcaagcaattctcctgcctcagccttctgagtagctgggattactggcatgcaccaacatgcctagctaatttttgtgttttgggtagagatggggtttcgccatgttggccaggctggtctcgaactcctgacctcaggtgatccatctcccaaagtgctaggattatgggatgagccactggtgcccagcctgtgggacagtttttaacaacaaattttatttctttaataggtacctatttaggttatctgtctctccttgcataaatttgcacctttcaagaaatttgttcattttgtctatcttgacaaattaaaggaatggagttgatcataatgtttcttattattttaatacctgtagaatctgtagtgatttcaccttcctcattcttgatactaataatttgtatcttgtcttatttttttcctgatcagtctggctagagatttatcaatcttattgatcttcttgagtcagcctttgttttcatggacttttctctattttctttcccctttctgttttattgatttatattctcatctttattttttcctatcttctcactttgagtttagtttgatcttctttttttgtttactcttacgtgtccctgcttggaagggacacttgtgaagtttaggtcagagctttctattctccttggcttatatctgtggtctaggaaaatgaaatttctatcaccttctggataaatcacactattatctatgcaggcaacaatagcacatattttctgaaagattacctttgccctcaagttaggttttatttttctagcagtctaaaggtcatgaaataaattataaaataaaaacagtgggtcttcaagctagaggatactgttttctttcttgcatggacaattattttaaaatattttggtttttctgcacttattatttaaatatgactccccacccccacttgaatctagggacattgtagttttctactgcagactttgtttctggtttatactgggaatatattgtttatcattttcagtgaaagcatccactggttaaatttccttttaaaaataataatggatctttacaatttctttgagctgctcagtgtgtataatgtgttgaattttctgttagtggttgggaggtagaaatagatactttatctctattttagccatttccataattatatatctcaataaccttgtcaatgcatcattagtcctatgactgaattaatgattacttttagtagtcacttagtttcttactggtgatgatgattctacttttgtgaatcatctttgatgattctctaaaatcttagaaagctaattttgttaatgctatgcatacaacacatcaatacattttctctattaaaaaaattaaagcgttataggtagatcagaatttaccattactaactcctcaagtcctccttatttccctgttaccagtttggtatatttatatattaggttgatccatatgaaattgccaatattatttctgaactgatgaaaagcagcaatttcttatgattcaacctattatatgtgcccatagactacatataatgactttgcatgtttttatattatagtgctatacctcaaatactgttctgcaatttattttttcatcaacaacgtcttttgataatttctttcatggcagtctatacaagtttctacctccctacttttaaaatgttgcgtaattttctaatgtttggatttgtcatggctttacttactccctaatgatgaatattggcattattaacacttgtagtcattagggttcatatgaatataaattgctcttataaagcattagtactatccattaaaactgcttttaggctgggcacggtggctcatgcctgtaatcccagcacttcgggaggccgaggtgggtggatcgtgaggtctggagatcgagaccatcctggctaacatggtgaagccccatctctactaaaaatacaaaaaattagctgggcatggtggcaggcgcctgtagtcccagctactcgggaggctgaggcaggagaatgccgtgaagacagagcttgcagtgagctgagattgtgccactgcactccagcctgggtgacatagcgagactccatctcaaaaacaaacaaacaaaaaaacaaacaaacaaaaaaaactgcttttaaatgtatttgtattgaaaaatactgagatatagtccttctatttagttaaccaaccaaccttccttccttcctctttttttttttttttttttttttgagacagggtctccctctgtcacccaggctggagtgcagtggcgtaatcttggctcactgtaacctctgcctcctgggttcaagtgattctcctgcctcagcctcctgagtagctgagactacaggcgtgtgccaccacgctcggctgttttttgtatttttggtagagacaggatttcaccatgttgcccaggctggtctcgaactcctgagctcaagcgatccacacactttagcctctcaaagtgctaagattataggcatgagccaccacacccagctggttaatctttcagttgttcctcaagaaaagtaattcagtcgttttatgttttgaccttgaacataacctgttgtgtttcaactctgtctttccaggcttcggttgtaagctttttaaagaaagaggattgtattttatgattttggcagtgccctccttgtcttcttctacaacttctagttcagagctttattttgtttcatatcactctagaaattattaacaaaccagtggctacttagttgatttagtcaaatagaactaagtccagactgaacaatattggttgataatcatttggctgatactgaaatttggatgttattcaaaataatattctaaagcggtgctaatagaaatataatgagaaccacatatgcaatttaaaacttcctagtagccacattaaaaagttacagtgagctgggtgcagtggatcatttgaggtcaggagttaagagaccagcctgaccaatatggtgaaaccccgtctctactaaaaatacagaaattagctgggcatggtggtggacaactgtaatcccagctacttgggaggctgagtcagggagaacagcttgaaccaggaggcagaggttgcaacgagccgagatcgcgccattacactccagcctggtcaacaagagtgaaactcctctcgaaacaaaataaaggttatagtgaacaggcgaaattaattttaatgccttccattttgaccgatatatctaaaatattaccatttcaacatgtaatatgtaattatgtgctgtattttatgtttgcaggacatctcagttcagactaactacattgcagatcccaagtgtgtgtcattaaaatagtgatagatttgtggtgtacatacctataatattatcatttatagtttcttgattagaattctgcataatcaagtcttactaagacaggtttattatattttctcattacttcttggtccaaaggaattctacctctaaagagagaatgagttgaataataaaatgtcatgactccattttgctgtagtatcttagcattaatatttggaattgttattctagaccttagcaaaaatatatgttttgattatgaattttctgaagctttccagttaagtgtaaaacaagtgaaaaatataacttcgtattttgtgtattttgctttttataggtgtctactgcagatatttcatcaaataaggatgatgaagaaaactctgtgctcgatatggttgtgttgttttctagcagtgacaaattcactttgaatcaggtttgaacttgacaatttactgtcttcctcattgaattcctccttgcacatttctgctttatctcatatacacagaagtgatccaatatttagctatagagctatattagttaagaaggtatttttaaagtaaaatttgtaggtttttagcttagtctccatttaaaatatgttctgttttcttaacttcaggatacatgtgtagtttgtggcagttttggccaaggagcagaaggaagattacttgcctgttctcagtgtggtcagtgttaccatccatactgtgtcagtattaaggtaaacatccttaaactgagttaacaaatatgtattgaatttttatttggttttagtagtaacatgagctcccagttctcacaattaagtattatgattattaaacatatgtgacagtatttaagtactttaaatactgcttttaagggtttcctatctcaagaaatttgctcctctataaatcttatattgtactaatatcctgcttttgtcttgaaaaagtaaaacataaaaatatatgcatttaatttaaaagacaatttatactattcacaaagattttaggtttagctgattcattttgtctgttgacttataaagctgagaactggagtatttagtaaaaaattattatcccattctgttctttcccacattctgtctcctctgtgctcactcatatacaaaatgacattttctccttatagccaaaagaaagaaaacaagtgtcatatttaatgcaatcggtaataatcgagagtcagcactgctcactttcaagcatttcaggatagaggctttctggggaaccttttaagtggtatcgtgtgcttggttttaaatatggacaggtctcaatacttcactagttgtatctaaggttcttggttttttctttttaagaactcagtcttaataaaacttacatatttgaataaagtgtcatggccactggaagcaagcatggaggtatagctgtacagcagaggtcttaaactgtatactccacaaggaaatcttttctagtattgccataccatgtaatataaatactaacctcagtttcaataataggttgtgaaccatgagtgatttttataccattctcccctgcccttcagacatcactgtgttatatcattgtcagtaaaatgtcagtatagtaagcaaatcaacattatctccttcagaattctttgttgataactacactagtatttattttatagggtaatacaggtttttgtgaatttaggaatcaaaatgaaagattgtaattaatactatccaaaatagaagactagtacggttaatttctgtagttttttaaaattagttgctcatgctatgtgactgaaaaacacagagtatataaagccaattaaaaatggagttatatatgcataaaacatgtttcttttcttctttgtactttatattctgtataaaagtagctgctatcattagattttgttttttagaatgcttaatgttttggacctaaggaaattgaataagatccctttcaagatagtaatgtatttcttttaacccatccaacaattaccgaattcccattttacagatgagtacgacttacataagttaagattggacaattagtgcactatcagacacctagttattcctgtttttaaaaattatgtgtggttccttttacatgacactgttttggacagtatagaatactgcagtctcattgagaaatacagcagtatctagaaatatactagggatatatgaattggctcagcttgcatttttattgcaggaggcaattgtttgtggataagtttgatacctttgaagcttctttttaagcttgctggggcaagtctagaaagccttcactctaaggtggatattttcaaactttatggttttagaaccttaacactctttaaaattactggggacgccatagtttttgttcatgaggattttaactatggactattcagcattttagaaattaaaactaggaacattttgtaacacaagactacagaagcacaacctgtacaatgtcaatgtaatattatgatacaacatgtagcttctataaacaccactgtataattgtgaataaattaaagtgaaaaaaggcaaattaaatcttagtattatttaaacttgttttaactttacagacccactggggttccctagtccacattttggtagctgcagtcctagcattagtttaaccctatacttaagacttggcctttctgggatcactactgaattctaccccctgttcaccagtgtctttgtactctgactggttgtgcttcacttgtctttgagccttttgcaagctctggtaattgtgcagcttacacattcccagtagatgtactttcccctggttgtgggtctttgggcttctagaagtacggcttggtgttccaccaaagacttcaggggatcctttgtagatttctggagctcttagtccttattgcttcttcattttgagtactgtgtcctgcaaattccactgcctcgcctcccctaacctcagcgaggccattgattgtactctgctgaggttctccctccctgggcagcattctggaaaatgtttctaggcagaatatcataggactccctgagtgtttccttcctctcagagaccactgtctcctttactatgtgttgtccaatatctgaaaacagttgtttcatacactttgtccaattttctactatcttatgggaaaacaggctggtcccatatactccattatcgttgaagcatgtatccgtattagattataaaacatatctgtaacaactttggacatggtaccatggatggaatcctggatgacatcttatttgaaaaaacttttaaaactaaggctaaactggttcaatggaagaaaaaaatgatagtacaaccccagtacctaagttaaaaggaaatttcaaagacagagaaattgttgaagtgttgaagtactagaagtcaagaaacacaaacactaatgtttccattagatttgagaataagaaggtcttgacaagcctggcttaagcagttatgagtggatgtgggtgtagagaccagactgtagtgttttgaagagtgaatataagcggagaaacttgagagtttggttgtaaaagggaccacaggtatctgtgaagaaaacttagtaggaatgaagataaatattttaaaaattctgccactaaacacctcagatctgtctgccactttgtcttcaggtcattgtttaagccagggtcaggcagactggcccatagactaaatctggcccatttcctgtgtttgcaaataaacttttattgaaatatggccaagttcttttgtttacatatatttgtagcggtttttgcattacactggcagagtttttgtaaagttgcaacagatcatatggccctcaaaactttctgtttactctctggccctttattggaaatgtttgctggctactgctctaagccaccctgatcttaccccaggccatttccttcatttgggcaaataatatactaacttggtaatctaagacaaattcttaaaaatcaataagctaatcaaaataataaatatacatgtttaaaaatcaaatgacattaaaagcctcgtaatgggccaggtgtggtgcctcacacctgtcatcccagcactttgggaggccgaggtgggtggatcacttgagggcaggagttcaagccagcctggccaacacagtaaaaccccatctctactaaaaatacaaaaattagccgagtgtggtggctcattcctctagtcctagctactcaggaggctgagccaggagaattatttgaacatgggagctggaggttgcagtgagctgagatcacaccactgcactccagcccaggcaacagagcaagactccatctcaaaaaaaaaaaaaaaaaaaaaaaaggccttgtaatgagcaaccaactcttgtcttactctacgtccacatctgagggaatcacttttaatcttttcaggtcttttttcttgtggttaatgctatagctctaaataatcaactggtttactgctttatcaatgctagattttgttgactttctgctgtgaataaataaattctgatttaggtcttaaaatacacctccttccttctcccaatatagttgtattactatgtttagttcaattaataaggtgttggttatgactcagtaaatgttcactgcagatctaaacagtatactatgagtttcttttgtctttcatggagtttttaataacaagaaagtaatagtgactctccattcgtactttgtttttgcctactatagaactatcatataagattattttttaaagtactgtttttttctgggagaagtcctaccctctttctagacattcccttctcctgctctgatatgtgccagtggcttctgggtgtgttgttctcatccttaaacttccctggcctgatgtcctttgtcggatctgttgatttatagatcccaagtcttccttttctttgtaatacatcctcattctgttctgcatatctctaagtaactttattagaaggagaatgaaggagctgaattttgagtcttcctgtgtctacaacgtattctgtcttcacacatagttgcttgtgtagctaggttgagaattgtactttgaaaagtattttcctgtagaattggaagattatactcttctagcatctggagttgggaagttttgtgccattctgatgggtgttcctttgaatttaactcttttattttcttctctggtagcttttaggctttcttgtacctcatgatctgaatttttattctgtaccctcattacttgctgtttcattataatgtgggcacttgattggttctgtctgaggatcctagtcttttgagatctttaagaagttccgcaatcttaatattacatggtgtggcttccttcaggagtttgttagggatttggaaattcccaaatattctgctaacttatacccttgagagaggggagaataaacagaggagtgaatgtgaacttcagaattcctagcttcatagtctaaatagaaatcttctaagatcataaaatgtccctaagaactcatgctttacattattttttttggtattttttctattgattctaagcatggaaatgtagatggagattttgttgatgtattttcaaattatgtatcaataatagtgaagcttacttgatttctttaaaatctggtcactatatctataaatacagtggacattaaatgtacagcataaggtaattatgtggactttaaaaaggcattaaaatatgtgccattttctattattctgctcagtagcctcctaaaagcgtgtatgaacatgcccaacccagtattgggcctccgtaggcgctcaataaatgttagttgattgcccctttctgcttctaggtacataagcaccatattaatttatatagtatatttgattatgttaggttaatgcataaatcacatggattggttgtttcttttacagatcactaaagtggttcttagcaaaggttggaggtgtcttgagtgcactgtgtgtgaggcctgtgggaaggcaactgacccaggaagattcctgctgtgtgatgattgtgacataagttatcacacctactgcctagaccctccattgcagacagttcccaaaggagactggaagtgcaaatggttctctagggtttgtttgccttgttagtctttcaagttcagagctttctcataccactttagtttttaaaaattagccatacctatttaattgaataatacacatattctatgatagataccactaatcagaaaaattttcacatacacattaaatcatttgccccattatgttcgtatgtagcttcctgaattacagtaactgaataactaagaaaataaaattgagacttttcggggggatttggatttcaggtgtgtttggtgcagacactgtggagcaacatctgcaggtctaagatgtgaatggcagaacaattacacacagtgcgctccttgtgcaagtttatcttcctgtccagtctgctattgaaactatagagaagaagatcttattctgcaatgaagacaatgtgataggtattgtgctattttttcatctttttaaagcttttctctttgaaatgtagcaaaaaaaaaaaaaggaaaatagcttttccttaatcacaagttttaggtacagagctttttgccttgtagatttttagtcacctagaaacttacagaattgatttcctgttttgaactctcaactccagactaaagttttgttttgttttgttttgttttgttttgttttgttttgttttgtttttaaatttacagacagagtcttgctctgtcgccaggctggagtgcatcggcgctatctcggctcactgcaaactccacctccgcctcctgggttcaagcgattctcctgcctcagcctccagagtagcagggactacaggtgcatgccaccacgcccagctaatttttgtatttttagtagagacagggtttcaccatgttggccaggatggtctccatcttttgaccttgtgatccacccgcctcagcctccctaagttttatgattataggtgtgagccactgtgtccacccaagactgaagatttttaatttaggcctttttgagggtttaggaatcccttgaaattagatggagaattattgccttcatctatgctgtttcttatgaaggatttctgaatcttttaatagattataaaaaatatctaacactttctgttctccttaaaccactttctctagaagctctagatactagatatctaggtattagatagcaccttctgccctccctacgtaattatgtggaatttcaaaatcaagaatgtttccttgctttcattggtatattgttgtactctttagaagttaagcagtgaacatatattgatagtattattttatcagtagtacagtattcttgggactctggctactaattatctgttccattgcaagacaactttttactttatttcccaattaccattcaacatcgctttccatgatatatgtctacttcaagttagatgcattgcctggagcccatatatgctagcactgccatttgccgttttctgaatacctttgtgtttgccctaactagcttccttgctgtctttgaaatatttaatatatgatgataaaataattagcttccttatgtaatgtgctttgcttcctctctaatagttgttctcattcctttttatttcctccttagctctatgaaagtttttctgttaatagggatagttaggagaaaagggcaaggtaggaggagcatgtgaggcttagggcttttaagtttgatgactcagtgttacaggttttaaaaggtagcagttctcagtatattccattttttttaaaaaaatgtacaaatatggtctttttagatggatgcatgcagttcgtcagaacttaaatactgaggaagaagtggaaaatgtagcagacattggttttgattgtaacatgtgcagaccctatatgcctgcgtctaatggtaagagaataatttaaactgtgagtctgcactcttgtaccactcacttgcaccttactgtccataaccaatgaattagcttagctctactctattttgtctttgtgaaacttactttgacaagtattttatgaaaaatattattgttggttatacatgacttatcacaacttgttataaaacaatttacatgaaacaataaaaagcatatactttagatgtaaactataattttgcttccaaggaacatgatcttgtagttattgacaatatgttaaaatccaatgtgttgattctttcttagccaggttttcctccatgacttgagtatttccttcatcacttcttgttttgttgttgctttaaaaagtgcttttaactttagtgttcaaacatttattttaataaaatgagtatagaaacagaaattttaatcatatgtaagtatgtaaatacactctaccttttctgaaaagaattacatggatttttttttttcatttcagtgccttcctcagactgctgtggatcttcacttgtagcacaaattgtcacaaaagtaaaagagctagttaaaatttgaaatgctttacttaatttaattaatttactttgcttaatttttacataattggcttaccacttgtaaaatctgcttcaatcatatgggtgttctatccaaattctgtaatgttggtaatcatttccacaatgatatataaaatgtcatccagctttactggggcagtattcctataaatttcagcaagttggcaacaaaaataacagctcttagaataaccattaatgccatacttgctttggtttcattgatatattactgtgcttaattatcagttagcagaaaatacggcctagttagcaagcagatttcttttagaattaattcaatctcttaattttttaaaataattaataagcctagtatggtgattaatatgatattcttattaaacagtcattcttttgaatacttgtatttaatagcacctgatacaaaaacatttggatagtacagaaattgttctaaggaacaacagttttgtacatttaaaattaaatctgcaggatttgtacttatttattacttctccctattagtaattatgttgatactctgatttttccagatgagcttctggagtattctctcttctcttgtgtaaatagatccctgccttttgatcttttccaggaaaaagctcatagtggattagctgagcattgcatatatttgcagtgcttctaactctttttattgggacatgaacataaaaatgccaggaagacttttttgagacggagtctcaccctgttgcccaggctggagtgcagtggcacgatctcggctcactgcaacctccgcctcccgggttcaagcgattctcctgcctcagcctcacgtacagctgggattacaggtgcccgccaccacgccgggctaattttttgtatttttagaagagacagggtttcactgtgtttgccaggatggtctcgatctcctgacctcgtgatctgcctgccgcctcagcctcccagagtgctgggattacaggcatgagcccccacaacaggcccaggaagaccattttttaaaaacatgtaacatttctgcctataatccaaggaagtttgacctattgttcctagtttttattgggtatcatgaaattaattattcatgcatttcatagatacgtaattactttctagaactacagtcacattcccttgacatgggtattttggaacagtaatcagtcaaatttaaaatgaaagtttaaatttgtattcttgggattttgtaattttagacccacccaagacttatacccaggatggtgtgtgtttgactgaatcagggaagactcagttacagagcctcacagttacagttccaagaagaaaactgtcaaaaccaaaactgaaattgaagattataaatcagaatagcgtggccatccttcagacccctccagacatccaatcagaacattcaagggatggtgatatggatgatagtcgaggtaatactaatttattttccgtgaaatatgtgtgcaagaattacagcatataaagtaacttttgaaatatgtgtatggtttaccaaagggtaaatcacactgacttagataaccccgatgtgacccttgccatctccaaatgagtgatcttcttagaccttgccttttcgggttctcttcctttcacacattttagaacagacctaccttacagaaatctcaaggagcaccatatctttgaagatcacaggtggggaaatacagaggtcttgactttagtttgctagataacgacacaaaccttctcagatactgtgagcttggataataccatgtttaagttaaggtagttgaggcatacattctagaaatggaaaagctgtcatttaatattacttcaggtataacttcatattcaccagtgtgcatcataaagtattggtttataaacattttcttaatcaaagtaaatataaggtttttctagctgaattctttttttttttttttttttttttttggttgggagacagggtcttgctctgttgcccaggttagagtgcagtggcatgatcttggcttactacaacctctgcctactgggttcatgcgaccctcctacctcagcctcctgagtagctgggaccatggatgtgggcccccacgcctggctaatttttgtatttttttgtagagatggggttttgccattttgccaagactggtcttgaactcctgggctcaagccatctgctctgctcagcctgctgaattcttgagatagcaaaatattttaatagtaacctaaaatccaatatgaattaaagaggattactgtaggtttcctcatttttggggcagttatttattttcaactgattcagaagtgaagtgataattatttctgttccattacattttatttcatagctttttttttttttttttttttttttaaggggcagtgtcttgttacattgcccaggctggtttccaactcctgggctcaagtgatcctcctgcctcagcctctcaagtagcaggtactataggcatgcgccactgcagccggcttttagacaatagaatttattgaatacctactgtatgtcagatgttggaaatcatatcagtgtacaaagcaggtagaattctctgcatagagtttatattttaatgttaggtaactcaactcttaaaaaaaatcagttaattataatgtgtttggcaagttccatggtaaaaataaagtttgataaagaggaattgcctggccaggcacagtggcttatgcctgtaatctcagcactttgggaggccgaggtaggtagatcacttgaggtcaggagttcgagaccagactggccaacatggtgaaacccgttctctgctaaaaatacaaaaattagccgggctcagtggcatgcacctctaatcccagctacttaggaggccaaggcaggagaattgcttgaacctgggaggcggaggttacagtgagccgagattgcaccactgcactccagcgtggttaacagagcaagactccgtctccaaaaaaaaaaaaaaaaaaaaaaaaaggaattggaagtacagacaggtgtttagagtccatatgaacagaaagcagtatttgagcacagattttaaagaggtgagtgagtgagccacttgattacctgagagaagagcaccccagacagtgaagaagccagtgtaaaggctctgggtgagagtgtgctgagcatgtttgaagagtgttgtggagaccaacagagtgagcagaggggacagtcagaaggtgagaagattagagatgtgaggacaagaaggacggctcagtatatctcacacaaccataaggtgatgtgtcagtagtttgtgcttaatagcaatggaatgggaggccattgaatgttcctgaaaagaagaacaccatgatcttatttatattttaagaggaacactctcctatgatataagtagatgattaggtgcaagagttatgacaggtagatcagtgagaaacaatggtccaggtgagaggtaattgtggctttgaaaaggtatgtcttttgtggccgggctcggtggctcatgcctgtaatcccagcactttgggaggccaaggcgggtggatcacctgaggtcaggagatcaagaccatcctggccaacatggtgaaacctcgtctttactaaaaatacaaaaattagctgggcgtggtggcaggcacctgtaatcccagctatttgggaggcagaggcagaggattgcttgaacccaggaggcagaggttgcagtgagccaagatcgagccactgcactccagcctggtgacagagtgagactccatctcaaaaaataaataaatacatgaaaagatatgtcttttgtatgttcttgataatttttgttttgtagtgtgttttgggtctatgttgctgggagaaacactttctgatgtttgtatgtaactgattttcagatacagttgaacaggtaatttgatttgggggcttggagtttgcaaagaagtagtccatatacttggaggaattgatcagatcagcattaacaagaatttccatttctgaggatgttaaaaaatgtctgaaaaaggtttccatagtctcttaaatttgggaagtgctccatttcacaaaatatgaaaggtttcttgataatagtacacattgtttcccaaattatgtgattataataccttttaaaaacaacacagaagatcttggaaggttttccttgtgacttaccacttgtaaacactgagaaatggtgatatgtttcaatttcatattttctcattgactcgtatcatggtaaaagaaaatcagttgaaaaattacccttgcttttttaaaatttacgtgataaaatagcccatctgaatttactgaatttgtctttatttttattgaatatgaaaaaagattgtttagtgtgttagatgttaaatgctaagacaattttagaatttaaggaattgaatatacagtattttcatgactagtccctcacgttcctttacatgccaggatctcacatcctttgcagaaggaaaggtacattcctagggataaaataaatgcatgttacttggacaacatttttgctttctgtttgctaaataaaaatcctttttaaaaatttagtattgccaaactttgccatattaaaaatgttttagattactatattatcctgaaactgcatgtacacacacaccactaaaataagttttatggtatttcatatgcctgtacgggagaaaaaataggaaaagaatacaatcatcataagttcttattattacattatgctgagatttctaataacgctgcccttttctgggtattttgtattaaacctaaaatttgtgatgttttagactgtttcactaacatgttttgataacgtctcagtacccttgggaaagcattataaagtagtgggcaatgatgaaacctactctggatgtttttaggcaaattttttaacttctctgattctagtgttctcttttataaaataggtgaaccaggatgagcccataggatagttgtgctgatgaggtgcaaggatgcatgccaggcacccagcactggctcttcccagacatggagtgctcagtaatcgtgagctattagaatacaggtgcccaaccagtgcttgagcaattgtgttctgtgtccaacagaactcaacagaatcccacgtttgtctttatatgtgaattcagttccttttgagttagtaagaaattttgcctgtgttggggtaattgaactttcaggaggagggaattgtctgccacaattattctctgaacttaatgtttccatgtctttttcttcattttggaagttgtggaaaaattataatgaaagagtatataaacgttttcctctgtattatagcgtatctgacagtttcctttattaaaaagtatgatacattagggagagacttaatgaatttaaaattaaagtttgaaaagtgttattgactataagtgatcttcagctgtgcagttttcaacttgaggttgtcagaatgtaatattacacattatattacacacatctacagaatccaaattgtgatgttcctggagtattggaacaatacctatgactttttgtttctattgatttttaactcttctaataaccacttctttaagaaaagtcatacatcatcactttggtgtatcagaaacaaattccttatgcaataaaagcatacttctttctcattcacctactgggatctagaaaccctgttaatgcaagaaaaaatcccaaacctcaataaaataacactctgtttgtctgaagagtggaaacacaacacatttcctctcaactggtggtcccagatcgaccatcacagtgtatggatgtgtttggaggtgtgggaataggactgctctgaggctctagaaggccagcaggttgggcagactgaatggagggaggggactggcattcagtaactactggagcgtgggaagagtgaggtagactgtccatctggtgaaggtggctgcttccttgaggtttgttactttctgtaatgttaattccctcaacttttaaaatttgatttttagacaagttatacattcaaatgatttaaaattggaaaataataaaaaggtaaacagtgaagtctctccctttcccctgccttcatgcccccagtttgcatctccagaaacctcagaggtttctcgtgtaactttccagatgtgttttatgcatgtacaaggaaatgtgtgtttatatatatatagtgtgtgtgtgtgtgtgtgtgtgtatatatattttgttccttttgtcttactactttttactgtccttcatttttttatggctgcaaatattcctttgtatggaaatataagcaatttaatttacctgttctttcccctgttgatagacctttgggtttctttcaatcttttttttttttttttttttttttttttttgagacagagtctcactctgtcacccaggctggagtgcagtggcatgatcttcgctcactgcaagctccgcctcctgggttcacgccatcctcctgcctcagcctcccgagtagctgggactacaggcacccgccaccacgcccggctaatttttttgtatttttagtagagacggggtttcaccatgttagtcaggatggtctcgatctcctgacctcgtgatctgcccgcctcggcctcccaaagtgctgggattacaggcgtgagccaccactcccggcgttctttcaatcttttactgtgaatagtacaatgaatcacctggtatatttataatgttgtaggtaagtgggcctgcaaaggtgaattccatgctaaatccaaagacataatgcatttgaaactgtttttggcaggtaggatacagttttttgtttttttcttcatttatttttattatacatatctgaggtatacaacatgctttgtatacatagtgaaatgattactatggtcaaacaaatgtctgtatccttcaccttccatagttactctctgtgtatgtacacctaaaatctctttcagcaaattttcagtacacaatattattaactatggttctcatgctgtgtattaatttgatctctagaattattcatcttacctaactgcagatttgtaccctccgacctacttctgcccatcccacccatcccctacctccagactcttgataaccaccattctactctctatacattcagcttctcaccccccggcctcccattctgcttcttaagtgagatcatacagtatttttctgcgtctggcttactttatttagcatactttcctcccggttcatccatgttgtcacaaatggcagtatctcctttcttaaagctaactattccattgtataaagtcctcattgtcatcagtaagttcttagaaactgtggttaagaggggaaaaaaagtatgacaaaactgattttttttttcattttgcattatgccaaaattagattgaaggaaacagtgttacttgaggacctgctgtatgttcatttagcttaacgtctcagttcccaagaacctattgatgacattaagggaggacttaatatatgtataaacaaatgtcacaatttctttatccattcatctgtccttgaatgggtaagtaaattgtccattaggacacttagtttgtttccatgtcttggctattgggagtaatgccgccatgaacgtgggaatccagatgtctctctcagatgctgattttattacctttgaatatatgcccaacagaggcattgttggatcttatggtagttgtattttttttaaggaaactctatactgttttcaataatggctatactaatttacattcctatcaaccatgtacaaaggtttcattttctacacatcctcaccaacacttatgtctttgcctgtttgttaatagtcattctaagagacaggagatgatatctattgtggttttaattttcattttcctcatgattatgatattgagcatcttttcatataccatttgaccatttgtgtgactttggaaaaatggctattcaggtccttgcctattttaaaatccagttatttggggatttttttttgctactgagttgtgtgagttccttatatgttttggattttaaccccttatcagatgtgtggtttgccaatattttcccctaatccctgtgctacctttttaccccatgttttttttattgctatgcagaagcttatttgcttgatgtagtcccacttgcttatttttgcttttgctgcctgagcttttggtgtgatatccaaaaaatcattgtcaaggaggatattaaggagtttttctcctatatttccttctaggagttttatggtttcaggtgttaggtatttaatctatttgagttgctttttatgtatgatgtgtaagataggcatcaggtccagtttcattcttttgcatatagatatctagttttcttaccactacttattgaagacaccatcttttccctattgtatcttattggacttgtcaaaaatcagctcataatatatgtttgggtttatttttgggctctgtattcagttccattgatccatgtgtctgcttttatgccagtaccatacgttttgataactatcactttgtaatataagttgaaatcaggtagtgtgataccttctactttgtttttctttctcaagattcttttggctattcagggtcttttatgatttaatacaaattttagaattgtgttttctatttttgtaaaaaatgcctttggaaatttgatagggattgcattgaatctgtagatcactttggatagtatggacattttaacaatattcttccaatccacaaacttggggatatcgttatatttatttgtgtctgtaggttttttctgttttatgagacagagtcacgctctgttgcccaggcagaagtgcagtggtgtgatctcagctcactgcaacttccaccgcctcctgggttcaagcaattctgctgcctcagccccccaagtagctgggattacaggtgcctgccaccatgcccgactggccaatttttgtatttttagtagagacagggtttcaccatgttggccaggctggtcttgaactcctgacttcaggtgatctacctgccttggcatcccaaagtgctgggattacaggcgtgagccaccatgcccggctgtgtgtcttcagtttactttgtcagtattttatagtgtttagtatataaagctttcacttccttcattaaatttgtttctcggtgttttattctttttgatgttattttaagtggaaatgttttcttgattttttttcagatcattatttgtataaagaaatgcatctgatttttgtatattgattttgtatcctgctacttgactgaattcatttattctagtaactgtggaatttttaggggtttctacatacaggatcatgtcatctgcacacagggataattttacccccttttttatgctgatgccttttatttccttttcttatgtgattgctctggctaggactatggtgaatataagtgttaagagtaggcatccttgccttgtagcagatattgaagaaaagctttcagtctttccctgttgtaggtttgtttttgaataggcaatacctgtgcatgatacaagaaatacaaaggtcttaaaaagagtgaacaatgttaagttagcctaccttttggccatcccttccttggaaagaaccagtgttttcttataactttccagagattagtcatctagatacaagtatgtatatatgggagaatttctcatatttgggtgatatggtctttttctcttttcttttcttttcttccggtctgtctttctttctgtcctcgtctcgtctcttctcttctcttttcttcatttcttttgatggagtcttgctttgtcatccaggctggagtgtagtggcgcaatctcggctcactgcaagctctgcctcccaggttcacgccattctcttgcctcagcctctggagtagctgggactacaggcacccaccaccacgcccagctaattttttgtatttttgtgtttttagttcctctcctctccaggagaggaacaggggccacagggagctgatcatgaaacacactgagggtgtttcatcagggaagtgacaggagcatagtcacattcaggaaagatcactgcctctgggaagacagagggtcagggcagagcctggaggccaggagagtgccaccttcaaacagggtggaggaggcacaattctggacagggatgtccatggccagaggagtgatccagctcctagaagatgaggagagaccgaaggtgaggatggctcttcagtttcaggtttaggcacctggacagatggtcttgccttctccagcggcagaaagcactgaaggggaaagaggttgggggaagggactgtgtaggctgagcagcctaagtctgagaagctgggccacttgcaggtgttggtccagggtgcaagtgcatttggtgaagggggagactaggaagggaggagaaagtctagtctgttactagacctcaccatgctgcaggtgtctgggccagcaggtcgcagccggagctgtgcagctggctgctgtcacatccctttctctcccagctgccttcagctgagcttaacgccagcagaggccgaaacacttcacaaatgcaacttgtcagctgggaggtgcactcagagctcaggaacactgttttccctctttattgttttccatcatttttttttttcagtctgggttttgggccccgtcagttccttttctgttcaacactgagctatgtatccacccctctcaaggttgaaaaagagaaagactgtaaaagtgccctgcaaagaagaggcttccaactctctgggggtggggggggtggggggctctcttcctcctcttgtcttctgggttcattccaaattattccccaaaggaaaaatcactgaaggactgggggcggtggtggggaaaaggacagtctcccaagaggtcaggtgaagccccagcctcatggtgttgagggaggggctgggggaagcgggagcctgttcctaggagacactgtctactggacacctcatcctagaaggcttccctgagttctgacactgttctaggagtaggaatcattatcccacgctgtggagaaggaaaccaaggccgggtaaagtaatgtagggcccttaaagttgcagagccaggaataaagtccggattggggctcaggtctgtgggcaatccaaggccgtcccctttacacttcaaatgctctttccccctccggaagccctcgcgtcctcatccctaccccacctcttgttccccaagcgtggctagggctagggctccagggctacgccaagcacccttcggtcttcccgggaagaattttccccggcccggggctagggtctggcgctggggcgctcctgggacctgcgggatcaccactacactctggcgcgccgagcgcggtgagctaggacgccaaggcacaggtggggctggagtccagcgcggaggcgcggggggcgggacgcggggccggggagcggccagggaccgcggcagcgccgcagtgccagcccggcgctggcgactgcctgccccagcccctcagtggcggcttgctctcttctctcgctccgaaccagacacagccgctgtcgctgccatgtggcgcgccgcagactcccgagaacagccctggctgtcagcgggcaccagccgcttcctgtgcccatcgcgtagactggaggggcgcaccacggccaccgagccagaggcgcttcaggaagcaagagaagtccccgcgcgctccgggacccggcgcagctcatggtgagcgccctctggggctcgagggtcccttggctgagggggcgcatcctcggggtgcccgatggggctgcctgggggtcgcagggctgtagttgggatcgcgcacaaaccgactctgcggcccagcccgaaatgctgccgccaaggagcaacggcaccgcgtacccggggcagttagcgctgtaccagcagctggcgcaggggaatgccgtggggggctcggcgggggcaccgccactggggcccgtgcaggtggtcaccgcctgcctgctggccctactcatcatctggaccttgctgggcaacgtgctggtgtccgcagccatcgtgcggagccgccacctgcgcgccaagatgaccaacgtcttcatcgtgtctctacctgtgtcagacctcttcgtggcgctgctggtcatgtcctggaaggcagtcgccgaggtggccggttactggccctttgaagcgttctgcgacgtctgggtggccttcgacatcatgtgctccaccgcctccatcctgaacctgtgcgtcagcaggtcatcagcgtggcccgctactgggccatctccaggcccttccgctacgagcgcaagatgacccagcgcatggccttggtcatggtccgcccggcctggaccttgtccagcctcatctccttcattccggtccagctcaactggcacagggaccaggcggtctcttgaggtgggctggacctgccaaacaacctggccaactggacgccctgggaggaggccgtttgggagcccgacgtgagggcagagaactgtgactccagcctgaatcgaacctacgccatctcttcctcgctcatcagcttctacatccccatggccatcatgatcgtgacctacacgcgcatctaccgcatcgcccaggtgcagatccgcaggatttcctccctggagagggccgcagagcacgtgcagagctgccggagcagcgcaggctgcgcgcccgacaccagcctgcggttttccatcaagaaggagaccgaggttctcaagaccctgtcggtgatcatgggggtcttcgtgtgttgctggctgcccttcttcatccttaactgcatggtccctttctgcagtggacaccccaaaggccctccggccggcttcccctgcgtcagtgagaccacattcgacgtcttcatctggttctgctgggccaactcctcactcaacccagtcactatgccttcaacgccgacttccggaaggtgtttgcccagctgctggggtgcagccacgtctgctcccgcacgccggtggagacgatgaacatcagcaatgagctcatctcctacaaccaagacacggtcttccacaaggaaatcgcagctgcctacatccacatgatgcccaacgccgttccccccggggaccgggaggtggacaacgatgaggagaaggagagtcctttcgatcgcatgtcccagatctatcagacatccccagatggtgaccctgttgcagagtctgtctgagagctggactgcgagggggagatttctttagacaaaataacacctttcaccccaaatggattccattaaactgcattaagaaaccccctcatggatctgcataaccacacagacattgacaagcatgcacacacaagcaaatacatggctttccagtactgctccctttatcatgtgtttctgtgtaatagctggtgtgcttagaaacctcaccccattgattgatagttcaaagaattggcagaagcagttgcaataaactcagtcaaatgtacccagcctaccagagatggaacaatgatcctgtgagagaagagagtatggtgctggctccttaaaaaaaaaaaaaaaaaaaagatacttggtccttaaaaaatatgctctcccctccctttttaaacaaatggctttttcagtcacttgtttgtgtttgaattgatttttaaacagcaggttttgtgtgtgtgcagtgatgtggtgggagcacacctttcctgggtctggattcccgtggctttgtgcttgtgtcatttcttctctctgtgctggtgggggtctctttaccatagcttaagaagtctccctgatttattctggtatctaataaacacagattatttgtattatgtggtgactatctttgctttgctacactgggtttcaggattgcttctgaagaaacgatgagtgcatccttaaaatgcaaagaagacatttgctgggtctggaagtacatgcttattctctttacagtttggccttaaagatacaccagggcaaaggaccttgaggagcttctgttttctcaggtttctttttattacttatacacatgttgggtctgtgctgaaacctggcttcaatggcatggcattagatcttctcaagcccagattttttttttcatttggaatcttttttgaagtaacatgagacaactctccttattcctagacagatgcgatcagttcattgaaaagttcatgtagaataatatcttgaatctttctccatctgaaatctgtagcatgttttagaatcacatggcttttgagaaatcctgttttctgaagggctttgaaatgtgtgaatcaagatgctttaaaaaagaaatctatttttaaataggcattttccttagtggacaatagcaaataaagaaatgctttttaactaaaatgtagaagccagagatgaaatgtgaatgaacttgaaattggaaaatctgtaggtcgaggtgctcaatagaaaagcccagctgactccaatcattttgtttttcctctctgcagtgtgcacagtcaaggggagtgttttattccagacccacaccagttgagagcatagtattaccatcagatctaaatatgagcactattaatggaagcaaatgaaatgtgaatatgcaatttcttgcaagtccctgctttgaagcagttttatcaaggacagttcaatcaattttgatctctctaaggctaattttattgtcagtcttctgtgcagccaactgcaaaatgtgcagctcctggcacatcgtacttaataaatatttgttgaatgaatgactattctggaatagtgagattgaaagcaaatcctattcggtacatcaatttttatatataatttagtcaaaatgatactggaatctgaggcccgtgttcagtttctgacctcctgtgaatggatagctaagtgaaccattaggcaacattaggggcagtgaaaagcacacagctctacgattcaggagatggtcgcatgaccttgagtgagtcaattaacctttctgggcctcattttctgtctgtgtctgtaaatggaaagacttcagctggatcactgtttacccaattgtgctttgtgatgcagatgttaatggatggggtctctggtgaaataagttcagcaaacccaggttcaacacctgttttctcgataggacttcttagagcttctcctgtgcatgatgcatctccagtgcgagaagattctgtatcatttcccaatgccattcactttgtgaaccttgtttggtggaattcctgttactgtttcactggagtccacagtcactacttgagaaactcaaatctaactgatctggaagtctttacaatattctgttctaaagcatgggttgctataagcaaaatcttttgtgaaaaacactgttctaggctccagtttaaataagttctgtgttatggaaaatgggttatgtgaggactttggaatttccttctgtaaaatatcactcaccattcattataattacgtactatgctctaggcattgttctagatgctgggaatatagttgtcaatcaaattctctgctctcttggaacatttatgtgagctgtgggagagataagccaataaagagatctgtactatactgcactgcattgcactgtgctgtactgaccaggatagataatgccaggcaggggtaattgctatgttgcaaaaagcccagggtgagtagggtggtgaagctgctgttttatttatggtggtcaggggaggactttccaaagagccacatgaagagagaccttgatgaagtaaggattagagggctgctaatgtctgggaaggagagcaatccaggcagagggagtggcaagtgcaaaggcttggaaatgggattgttcttggcaccctcagaggagtgtggctggagggctataaaagaggagtgtgataggattaatgttaattgctgtagcagcaattgcagcaggcatgatggagacccagcctgtgctgggtacaatacatgtattaattcatttcactctcattgccctgtgaggtaagcacttttattaccccattttacagataaggaaatgaaggcattggcaggctaaataaccagcctgtggtcacataactcctgagtggcagagctcaacttgaacccaggtagcctggctgtggagtctttaatcctaactgctctttgatggtgagagaggatgccaggacatcttcagtcagcaaatgcactagtgcacagatcaggacattcagttttttgttcatttgttactgaaatggttaattgattcatccccacagctatacaacagcagatcttcactgtgtacctcctctgtgcacagctttgtgtttggagggaaggcaccctagggttatgggcaaagtagctcttacatgatggaccaattgctttcctggattcttatttattcctcacattaacctcacatgttattatttttccattttacaggtgaggacatgggggcacagaggaccttgaggacaaggttgtttgtccaaggtcatgtgaaaagtaagtagtggaaccacggttcaccctaggtcagtggttcttaaatgagggaactttgcaccctgcacccccacagatatttggcaatgtctggagacatttttggttgtcacaactgggtgtcaggtgctcctgccgtcttctgggtagaggccaaagatgttgctaaacaacttatggtgcacagagaattatccggccccaaatacccatcttgcagcacttgagaggccttggccaggcgggcagactccaggtcccagctccccgtccacaaggccacctgcctgggattggaggctccagtgccctaagtttgaagtttggctccaccatttattagtcttctgaatttgggcacctttctgagctccagcttctttatctgagcaatgggcacatgaaccacacagagcgtgaattacacaaaacacatgccccagatcttccttgttctgatacatgctgaatcttcttttataattaggcatccatacaccatattcattggttagaaatgagtcattacgtccaaatcatattcaaggggaggtgattagactttacctcttcatgggaggagtgccaaagaatttgcagaagagatgttttacattttatgctttatttttaaacacttgttctcacatagtttcagacttacagaaaccttgcaacacggtacaaagaatttctaaatattgtttacccagatcccccaaacatcagggtttcactgtatcacttatctctgttcttccctttttcttctgagtcatctaaggtgtgatgcccatttactcttgaatattttgttgcatatttcctaaaaacagggaattctctcgtctcatctacagactttattcagacttcacaataatgtcctttataacaaaacaatccaagaccatgtgttgcatttagctgtcccctgtaatttgaaagtttctgctgctttgtctttcttgacacagacctttgtgaagattacctggccagttacttggtataattgtccttcaacttcggttttttggtgcttttccatgatcagattctgttatgcatgttgggcaggaatatcactgatgccatgctgagctcctgtagctcaaggcatgaggggcaggtgctattaattagtcccattactagcaatgttaactttgttcatggggttacggtgctgtccaccgttttactctttataattaatatgtatttcctttggagaaatactttgagactatgaagatatcctattatttctcaaacttgcatccattggttttagcatttattagtagcccttccctgaatcagttattactgtggttgtcaaatcatgttttttaaaaaaattctgtaatctttctaaatgtattgttggttttctactgtaaggaagaacacttgtttatattattggcatcggcatagaatcttggttttctagttttctgtttgtttttgagacagggtctcactctgttgtctaggctggagagcagtggcatgatcacagatcactgcaaccttgactccagggctgaagtgatcctcccacctcagcctcccaagtagctgggaccacaggcatatgccaccatgcccaggtaattttttttttttttttttttttgtagagacggggcctccctatgttgtccaggctggtctcaagctcctgggctcaaacagacttcccacctcagcctcccaaagtgctgagatttacaggcttgagtcaccatgcccagcccgggtttctagtttttataataggttataatcttttacttgacgctgttaatggatactatttttacattccaggtatgggacctggggacacatgtgtcccatttctatgatattaacacaatgctcattctaggggcaacactcagaacactgttttctattgtcttctaagactgtccctgacctcaaatctctcagtgaactgagggtatccatacttatcatgatatttaggttgccctagatttggtgagtgggagccctttaagttggttcttgtgtccttttgacatgctgtcattattctttgagtagtttgttacttttcaacatgagatatgtcagactcatcttgtgtattccctgtccaagccttggaatcatccatttttccaaggagaccagggttccttctagcagaaaatgatatggagaaatcaagatgtgggcactagggtgtttattgttactggggtgatattgtttctatatcctcttaaaagacagagttgggaaatggatacatgtatatacatgcacacatattcatatgtgcatatacacatatccttgagcatctctatctatttctatgcctacctatgtacatatatcaaatcccatgcactcattttgatatctagcagacatattttaaaaaccatcacctctggttcaaatcttgattctctaatgttctagttcatgagaactggaagtcaaagagattaagttaccttcctaggtttaaaaaatgttaaaaagggaataattagttgcttaccttgtagtttattgtcagagttatgtgctatgatgcatgtggaatgtgtaagggtgttacacaatgagaatttaaaaatggtcttcttgtgactgtgcccttaagagctgagagtacagggcagaaccttcctgtttctatgtagtggttccatgctccattttacagacagtgtgagaagctactagggatcaagaattcaagagtcaatatgcaggagagggatagagtagctgaagagcaaactagacttgcctacacctagaataggaagaaatagcacaagatgtcaagcttgataggaggaagttgttgatatgaggggagagttaatcagagaatgttgagcccatgtggaaccccctggacctctaggccaatttgggggaagggcttaaagggaatatgagtacccctactcacaagagcaggcagagccatcagacttttgctttgacactgttaatgaagtaccattttgatattccaggtatgagaccaggggatacatgtctcccatttgtaggatattaataatacaatgccagttccagggaaaacactcagaactttgatctgattctcttctaagatcattgctgtcctaaaaactcttagtgaactatgagtaccagcactccaccaacactgacagaataaaggtgacaaccagcatttgttgactatctattgggcaaggtgctttgtatacatcttctcatggaatcactgcaatattcttgtgacataggcaccattgtcctcatttggaaaaggaggctgagagaggctcaatagcaagccaggttatacttctagtaagggatagaagtgggatttgaagagcatctactcctggagagccccccttttgggctttacacaactctttggagggactcaggaagaggagagctccttcatgtatattgcccatgggtcctctccaggtgaagtattttgaggttctgaaaccattatcagacttggctgtaaattccctctccatcttggaccttttcctgtgctcttccaatggccctttccaatgggtaattagacctcagttgtctacatgagtgagatctgctcagcatggagagggctctatttttctacacccttgataatttgtaggtttgggaaagcatgcccagtgtggcttgtcagggctaacacatatgccttcattcatatgtcaacttggcttcatgggtaggggctgcctggagtcctgggatgagaaagactacacaattgcattccaaccaatgacattgaggggactggctaataaatgatttctgttaggagcttgggaggtgggggatgtgtgaatgttctaagtacttgccattctgtgtctctccacagcccctaaacctgtctttcctagaaccacttgaaagttaaaatattgatgtctggggcccactccaaattagttaaatctgaatttctaaggaataggacctaagcttcacttttaaaaaaaaattgaatgtgttagaatgtatatagccacaattgaaaaacaccattggtctacactatcattaggcatgtttgaaaattatctgccttgaccctgccctgatcttgcctttgctacaatattaaatgggctcttattaacaatgaatatatctaattattctctagatcttttattagcttgaattattcttagatattctgccacataaaagtatttgaatgtgtagtctttgtggttgatggtctaatcagctaaactcaaacctcactgcagctgtgactagaaagtcctcattgatggagaatcctagaggtcctttcagagaagaaaaaataattcagtgggccaagctgtaatattttgcctctgattctcagattccttgttggcaaaatgggaatgcaaaataaatagagtctatagtcagtacctaataagtatttgttgaatgaataaattagtggaatacaaaattaaaatacttgtctcatcaaacatctagagaaaaaggagacagatatagagctaacccatgcctgttataccatttaatgctaggcgtatggaagcagatactgtgtctctctagtttcacaggctctcagagagagaggaactgtactctaggagctgcatgtgactagtcattctcaagaagtccccaccccaatacctgatttgatgagattctgaactttagttgatgctgaagggggaggagatttttagggatcttggcaggacacaagtgtattttgcatggggtggaggatgtgaatcactgggggctggaggacaggcttcccagcagcccctaagatggcctccagtgatccatgtctcctggtattcatgcccttgtataatcctctccactcccttatatcttggctgaacctaatgtcttgttcctaacaaacacaatatggtgaaactgatgaacagcacctctgagaagttacaaaaagaaaatgacttccatcctgctcaccctctcttgctctcttgctttcttgttctgatggaagccagcagccatgttgtgggtgttctatgaagaggcccagtagcaagaaaccagaggctgggggagtgtctgaccaagagtcagccaaaacctgaacctgctaataatcacatgagtgagcttggaaaggaagcatccctcagttgagccttcagatgagaccatagccttatattactccttgattgcggcctttgggagactgtgagccagaagacccagcgaagctttgcctgggctcctgactcatagacactatcagaaaaacacttgctgttttaagctgctaagttctgggttaatttgttatttagcaatagataactaatatagaagaaaagggagagaacatttattgaatcctttgctatgccccaggtactttgtaaatctttttccatttcatccttaagtcaacctggatgaaaatattcaggttcagagatgctgggtgagtgccaggggcaggatatgaatcactactgtttgatttgaaagcctgtgctcatttctctattccaggatgcaaaccaggagacgttttctattctatgtttcttttttcttttcttttcttttctttttttgtggcagggggacagggtcctgctctgtcatccaggctagagtgaagtggagcaatcatggttcactgcagcctgaaactcttgggctctggtgatcctcctgctacagcctaccaagtagctgggattataggcatgcgccaccacacctggatagttttttttttttttttaatttttattagagactaggtcgcactacgtcacccaggttggtctcaaactcctgagctcaagggcttcttctgcctcagcccctacaaagtgctaggattacaggtaggagccattgtgtccggccacattttctctgttcgtaaagtcagcagtagaatagctaacattgttgctaaacagtttgtataaaatgagtaattattagtgcccctgcatgcagccacctgctgttgctgaccttctgtgcctctgcagccaaacatacatcaggtacttatgtatacacactccacaggcacacagatgcctccacaatacacatgtgcccaagatgcaattgcaagcacacaagtgcacaaataagtacacacatgtgtcttcacaaagaactatctccaccttcattttctcccatccaagtactaatcaggtctgaccctttttagcttccaagatcagatgagattgggcatgttcagggtatatggctgtagcctacatcctcttttttttttttttttttttttttgagacggaatttcgctcttgttgcccaggctggaatgcaatggtgctatctcggctcacagcaacctctgcctcccgggttcaagccattctcctgcctcagcctccggagtagctgggattacaggcatgcgctaccacgcctggctaattttgtatttttagtagagatggggtttctccatgttggtcatttttaaatgaaagaccctttgagacagttcatacctaaatatgtaaatagtgcacaagattttgcagcctgaacagaaatggccactatagttttttctctttagcaattttctgtgtgctgtaaacaaatttgaaatctggctagagactttggaaatcatgttgaccactccccatattgtgcagatgcagaaattgaggccctgagggacttgcccaagtaccccagcaaagtggtgtgaactgaagtccaggtctcccaactcccagttgactgtccttgctgtggcactgtgcaccgtcggtggggagaacactcctggtccttaggaatccatttctaaaggacatcaggagcacaaacaagttcatgccctattgttctttccacgtaaaagaagttgatgacatttatgcttttctcacaatacaccattaagatagaacattgttgaattatttgtggattaaatacagatgtgcagggattttagggccctgattgattttctgttgaaagaagcgaaaggaatgttaatttacaactggcaaatgttagctcttaggaggaggcaaaacagcatttcgaaggcctgttttttgtttggttttggtatttcatgaaagagatttttctgtgcaaagtggcaggaagccattttcaacaagagctaaagggaatgaagatttaaaaaatggaccaaaaacaaactcaaaggtgccaggcctttgttactgcaagcccctcttgcaggatgagaggctgctaaaacaaaatcaataatttaagcaactttctgtccctctctcccctgctattctggtaaaatgatttgacatttcagacaacaaggaatgaacatcagaccaggaagaaaagggcttggttatgagtcccagttgtgtgattttaagtacatgattaaacgtttattaatttggttctctcatctctaataatgaaaccatcactcttacatcttgagtgtaaaaaatgctcatttactagaactcgccctgtatcagatgccacattaggatttgtgcggagtgatctcattaattcctttttttttttttttttgagatggaatttcactcttgtcacccaggctggagtgcagtggtgcaatcttggctcactgcaacctctctctgccacccggttttggtttcaagcgattctcctgcctcagcctcccaagtagctgggattacaggcgcccaccaccatgcccggctaattttttgtattattagtagagacggggtttcaccatgttggtcaggctggtctcgaactcctgacttcaggtgatccacccacctcggcctcaagtgctaggattgcaggtgggagccaccatgcccagcctcgttaattctttatagcagccttgtgaggaggtctgttcattctcactgtacagctgaaggtgctgaggctcagaaaactcaagcttgtcgctcagggtcacacagctaagaaatgacaaggtggagatttaaacctatgcttgtctggctaggcactgtcttatatagtaagagtgtggggatgacagattgcaaaacaaagcaaaataaaactcacaagctctgaagatgtagtgactgcctactctgcccctgtgctagcgacccagagttaaagatgggttctcatcatggtctctgcttctatggatccctcagtggcttgagaggaaagcaaacctggtggtggcaacgagggcatctaatattttggattccattttggactcatgtttaaagtgcatatgggctatacaggtgggtgtatgagccgaggacaagagcagaggtctgggtttgggaccaacatcaccaaagatgatagccaacactgagtgactgctgaatttgtgctgggcactgtgccaaagagttctcaggcattaacccattctttttttttttttttttttttttttttttgcggagacaaagtctcactctgtcacccaggctggagtgcagtggtgtgatcttggctcactgcaacctccgtctcccaggttcaagcaattctcctgcctcagcctcccaagtagctgggcctacaggcatgcaccaccacactcagctagtatttttgtattttagtatagacggggtttcaccgtgttggccagggtgtcttgatctcttgacctcatgatccgcctgcttcggcctcctaaagtgctgggattacaggcatgagccactgtgcctggctgcattaacccattctatcctcagactgatgctgtgaggctgctgtccttaccctgttgtacagagcagtgagaaaacttgcttgtaggtgaaagttaaaacttcaaggaggatttttcttgaaagccatcccaaggtttttctatttggtgattcatgatcaatcttatgccccaagtccccacattccctctattttgagtcactctgtctcataagagcccctggtgcctttgttttgcttcatttgaattctggattcagcatgcatcagaaatgttctccctgagagctggaaagcatttttgtgatggctgggctgcagggccattaagaaaatacctttgcacaccaacaaaaaagactaaagccttaattgctgatccaaaaggcaacaggaaaggatgcaccactgcatatatggtgagggatgcattgccttggtcagggcacaggtcctctgtccctgagtcctgtttccttgtgtgggtagagggcattttcacactctctgtccccaaaagacctcagggggaacaaaagagcagcatgagcagggggccatggtcatgggcattgactgggtgcttgctgcatgcaaaggctctgtgttaagcaccttgggaacactaactcatttactgtcccaacaaatccaggatgtaggtacaagtaatagtcccactttacaggtgacaaaaatgaggaatagagaggtttggtgatttgctcaagatcacacagtatgtgtggcacagctgagattctgacccacaggtgagactcttgagcttattcttctcactgaaccccctgcctctcatggttatgtggctcatgctcccatagccttaagtcctgaggctaaggaagggtcctcagataaaagacgtcaatttctgtgtcttttttgagcaggcttcatgaacatcaacactcatttgaggttactgagagcatttgcctggccttaacattgtcatcccaaagctgtttgccaattcattcccatcttcatagccctgtctttctccagcaggcttggtctgtggttctaatgaacacaggaggcttggttcattcggatgcaggaagtgaggaggaataacatgaaggggattgaccagatgcctcaattctaatcagctgaatggagatacttatgatacctccttatgcagtgctgtaacgattagatgggattctttatataaaggacttagaacaatacctggcatgttgttagtactcaattaactttatacaatatattagtcaggctttgttgtgatgatgccacataaaaagtaatccccaaatctcaatgctaacaacaacaaacatttacttctcatttccataggtcagctgtggttctacagggctcttctgggctggctagattcagatgggcctggatctgggtggtgaattgggttcctatttgcttcacttggctctcagaagaggatccaggggagtagcagcagctatctgaagcatgttcatctcatgctggaggacaggatcaccagaggccatgcaggaatatttaacgcctctgcttggatgtggcattcactgagtcacccacattccattagctgaagcaagtcacatggctaagcccaatgtcagtggggtggggaggtacaccacttccattgaaaggagggaaaacagatgtttgctgaacaataatacaatactatgatctatcacaatactatgatctaccattatactatgatctaccattaacatttcttgaatgcctaatagctctcaggaagtgttccaagaatcatggattctagagatgaatcacatagcagctctgctgtctgctctcaagggtgccctcactacagagtgtggtcactgcaatgacaaaggtggccccaggacaacttaacctctcctgaactattttaattctcacaatttccttgtaaccccagtatcactatccctattttatagacaaataaactgggactcagagaggttcagtaattttcttttgtccccatggctagaaaatggctaagcctagtaccaaatccttgtgtgattgttccagggttctgttctttgcatgacaactctggactcaggtatgtaggcagagacattagaattgagacagagactgaccaaaactctcatatcttggcaggagcccaagtctgcatatgtatgaacctcatccatatatatgcaagctgtggctgagacatctgtaacctagactttcatagctgggctactaacttcattcatctgaaggaagattcaagttataaactgccaccaattcagtgaattatccataaacttgtttctatattgccctatgatgctcagttcaagcccaagtcaaatgctccctcctgaaaacttctctgattccctagccaccagtttctgcctgtgttgcctgtccacagcaccaaacacttaagacactttctccatgatcctacaattttttttttatttttctgagacagggtctcactctgtcaccccggctagagtgcagtggtgcacatgatcctacaaccttgatgtatatattttaggcaatcactgctcacagaaagcccatattctcctattccacctccacagtccccagagttccagcccagtgcttggcattcagcaggggctagatgaaagtgtgtggaatgagtgaatgaacgacggatggatagaggctgctgggtccttaggaaagagagcagatgagatttattttttatttttgtccgtatctcctctttggtcctttggagggattttagtcaggatgggtctggtgcaaccaggtgatccaagggttataggcacagagggaagtaactggagctccctttgggtaccacagtaaacactggtggtggaatgccattgtcttatcttctgagaagtagcaggaggcttccatattcttgtgtttcgtcaactggctctaatcattaagctaaatactcagcttatgcaatgcacttagcccagctgatttagaagtggcaccttcccaatcagtctagagcatttgggtggtcactgtattccaacattcactacaattagggactgccagaaaagcctgattgtcttcactggttatttataaccaaatcatagtagcaatcattatgtaaaaagagctgtttctccacgcccccaacttctctgcctcgcccactcccaatgtcagtccttccattttatttaatgcttctggctgcagtgattagatgtaatgagagtgatagggctttgagttggaaagtgctagaggcaaaggagttttgttattctcatccttagagacacagaattcaagaggtaaaggggacttagagatttctagtccagcagtcccatgctatagatgggaaaacttgaggatcaaagttaggtagcttcatgaaaagggtataaatgtggaaatccaagactccagttctaactgaggcttaatcacagataacgtgtgtgatcttgagctacttgcttagtgtctctgggtctgagttttcctttctagaagatggggaaactaatacgtattctggagtgattagagataaggtgtagaagtagccaggtgtatggcagctggtacaatggatgccatagtaaaggagttggtgccagaatcactgcatcactgctctcttcccatcactccacattgccttcaactagctgagtgctcctgctgaagaaccgactcctatgttccctggctctcaacatgactcagtttgacttttcataagtgcaggtaagcaaggtaaaatgggagttctttttcctctctacagatggaaaataccagcaggagaccagccaagtagagctgggggaagtcttgagactcaccctatggtctccatgacctttgtcttagttcctttgagccgctaaaacaaaataccttagattgggtaatttataaacaatagaagtttatttatttatttattttttgcagtgtcagaggctgggaagtctaagatcaaggcatctgcagattcagtgtcttggtgagggcttgctctctgctttaagatggtaccttcttgctatgtcctcatgtggtggaaggggtcatttgttcatcttcatttcttttataaggtcattaatcccattcagaagggctctgtccaaatgccttaatcagctcctaaatgccccacctcttaaaactatcaccttgattaagtttccacatatgaaatttggagagacacagacattcagaccatggtagtccccatcctctgatgtggaccggcagcacactcacagtcttacataaatgactctgcaagtgcagctttctgagctccattccaattgtccctctccccacctccatagcagttttggtgaagccctatgtaatttcatgatctacaggtagatttgatagatggtgttatggtaccaggagtggggagcagccaaaacacaaaccctaaaatatgtggctctagggccagatggcagtcagcaagagaaccgttactgagggttggaaagatggtaatctatgttatgcagtggtgaaatatttggtaaagctgttgtaggaataacttgaagggcggatgatgtgctgaaggaacttgaagcttaaggtgaaaagatggggaaactgaacgttagtaacatcccttggtcactactgtaagaaagagatgagctcagaaaagaattggctaaattgtaagcaggtataaaaagaagtagagagggtccaggacttctggagtcccatttctcccaggaaggggcctgcctcagtatccatgccaagctcagttactggctgggagctgcttgtgggaatcacttccctctgagtgtgactcagtcatactctaaagtacgacatgactcttccttgcagagatctggacatatacagtgtccagtcacacggacagatgcagcttctgtggtcactctagatgatgctaacttccttatgctggcatgctatcctcataatgcaggctgcagttaactattttaaaagttaacatggtaagcagaagtgattcctctttggctcgaacatggactgtttggagggcactggagagaaccaaaagagtgagaagttttgagtgcttgtcatgtaagaaacaggaaagaaaatgcggcataattacctgtctctggggagaggagcaggattgcttttgttcctccaagtaggcagaaacagaaacactgggcagctggtacagagagacgggttttgagaggcagtactctcccagcagcactgtctagccagctgtctgcccgagtctgggggtgctagtgccttctgcaggattaccctataggaggcatttccagggtgctgatgtggactcatgccagaggtgacagtgtcagccatccatggtggaaacacaaaaataaggacacttagtgagcttggcccaagctattacattttcatctctgaggttatatttcccacacctttaccgttgaatgtccttttatcaaaatagtagtcattgtttaagtgatatctctatgttaaaccttacatttttttctttttaattttattgatttgtgaaatcctaaagtcttgaaactcctaagctagctgacttttcagatctgggatctcttttatctctaaatgattatgattcctgactttttttttgatataaacactcaactgccattaagagtgctcatgatagggaatagatgctgcatttgttcatgtttaaatactgaggctcaagtacctgtcagaaggagtttattatattttctaggctctctgaaattacatcagaaaaatgtgaattagaatataacccataaataatatctggccacatgcaaagtaattgaagatcaattgaaatagctattggattaagaaatagagactgaggtaaatttacagggtcagggaggatctaaggaggaagcattgacactggagcccagggacctgggattacagaacagattctaccagtgctaacttactgctccaaagaaaatatcaaatctgctcatccgcaggtactattcatcaagaaagggattacaagttcacaaatgtgttcaaaatgtacccatacttcgacatattaatgaagtaatcacattctacacatgactactccatatggaatactggggtgggggtgttccaaataaagagactgaggatttctcatgagaactcagtgtctgctagaaaatatctaagtaaaatattttacttatgtggaaggtgtggatgtttgtgcatcacaagtttcaagaatccctaaaatgtacaatggagatgaggagaaaatatcagaatttcccagcaccagaaatgaggcaagaaaaaattcagaggagttgtaaatgtgaaaagccaatggctggtcacacagcaacattgataaccttgtgccaggacaactagaataaatacataaacatacagattgaaagtatttccaatattagatctccctcatgtgagaactaaattataaagattgaagcatataagaaaataagctaccagaatttaggctaccagaataaattcgattacacataaatttctgatattgaaattctcacaaatgtttaagttggtagtggaagacaaaggacatataatcttgggagtcctagggccctgcccgctgccagttcctccatgctactacagctgatgctttctggaaagcaacacctcctggcaggaggccaaccagcacaaatatagagcattaaaccactaaagctaaggaccctcacagagtctattgcacccttcaccacctccactggaacaggcgctggtatccatggctgagagacccatagatggttcacatcacagggctctatgcagacaacccctagtaccagcccaaagccaggtagacctgctgggtggctagacccagaggagagacaacaatcaatgcactttggctcacaggaagccatgcccataggaaaagtgggagagtactacatcaagggaacactctgtgtgacaaaagagtctgaacaacagtcttcagccctagacctttcctctgacagagtctacctaaatgagaaggaaccaggaaaccaaccctggtaatctgacaaaacaagactcttccacaacccccaaataatcacaccagttcatcaccaatggatccaaacaaagaagaaatcactgatttatctgaaaaagaattcaggttagttattaagctaatcagggaggggccagagaaaggtgaagcccaatgcaagaaaatccaaaaaatgatacaataagtaaagggagaaacagtcaaggaaatagcttaaataaaaaataataataataataaaaaatcaggaaactttggacgcatttttagaaatgtgaaattatctggaaagtctcagcaatagaattgaacaagtagaagaaagaaattcagaattcgaagacaaggtctttgatttaacccaatccaataaagacaaagaaaaaagaacaagaaaatatgagcaaagcctccaaggagtctggcattctgttaaacgatgaaacctaagattaattggtgtacctgaggaagaagtgaattctaaaagccaggaaaatgtatttgggggaataatcaaggaaaacttctgtggccttgtgagagacctagacatccaaatacaaggagcactaataacacctgggaaattcatcacaaaaagatcttagcctaggcacattgtcattaggttatccaaagttaagacaaaggaaataatcttaagggctgtgagacagaagcactaggtaacctataaaggaaaacctatcaaactaacagcagattttgcagcagaaactttacaagctagatgggattggggcactttcttcagcctcctcaaacaaaacaattatcagccaagaattttgtatccagcaaaactaaacatcatatatgaaggaaagatacagtcatattcagacaaacaaatgccgacagaatttgccgttaccaaaccagcactgtaagaactgctaaaaggagctctaaatcatgaaacaaattctggaaacacatcaaaacagaacttcattaaagcataaatcacacaagagctataaaacaaaaatacaagttaaaaagcaaaaacaacaaaaaaaaacaaagtatagaggcaacaaagagcatgatgaaagcaatggtacctcactttttaatactaatgttggttgtaaatggcttaaatgctccacttacaagatacagaaccacagaatggataagaactcaccaactaactatctgctgccttcaggagactcacctaacacataatgacttacataaacttaaggaaagtggtagaaacaggcatttcatgcaaatggacaccaaaagcgagcagcagtagctattctcatatgagacaaaacaaactttaaagcaacagtagctaaaagagacaaacacagacagtatataatggtaaaggtctcatccaacagaaaaatatgacaatcctaaacatacatgaacctaacaccggagctcccaaatttataaaacaattactagtagacataagaaatgagatagacagcaacacaataatagtgggggacttcaatactccactgacagcactagacaggtcatcaagacagaaagtcaacaaagaaacactggatttaaactatactttggaactaatggacttaacagatatatacagaacatttcatcaacaatcacagaatacacattctattccacagcacatggaattttctccaagatagaccatatgataggccataaaacgagtctcaataaatttaagaaaattgaaattgtatcacgcactctctcagatcacagtggaataaaactgaaaatcaactccaaaaggaatcttcaaaaccatgcaaatacatggaaattaaataacctgctcctgaatgagcattgggtgaaaaatgaaatcaagatggaaatgtaaaaaatttcttcgaactggatgacacaacctatcaagacctctgggatacagcaaaggcagtgcgaagaggaaagtttgtagccctaaacacctacgtcaaaaagtctgaaagagcacaaacagacaatctaagttcacatctcagggaactagagaagcaggaacaagccaaacccaatcccagcaaacaaaggaaataaccaagatcagagcagaactaaatgaaatcgacacaacaacaacaacaacaccaacaaatacaaaacataaataaaacaaaaagttggttatttgaaaagataaataaaactgatagaccattagcaagattaaccaagaaaagaagagagaaaatccaaataacctcactaagaaatgaaacaggggatattacaactgacactactgaaatattaaagattattcaagggtactatgaacaccttttggcacataaactagaaaacctaggagagttggataaattcctggaaaaatacaaccctcctagcttaatcaggaagaagtagatacctcaagcagaccaataaagcaagcagcaagatcgaaatggtaattttaaaattaccaaccaaaaaaaccgaggaccagacagattcacagcagaattctaccagacattcaaagaatgtcttctttcattcaaagaagaaatgataccaatcctttcacactattccacaagacagagaaagaagaaagcctccctgattcattctatgaagccagcatcaccctaataccaaaaccatgaaaggacataaccaaaaaagaaaactacagaccaatatccttgatgatcacagatgccaaaatccttaacaaaatactatctaactgaatccaacaacatatcaaaaagataatccaccatgatcaagtgggtttcataccagtgatacaggaatggtttaacatatgcaagtcaataaatgtgatataccaaataaacagaattaaaaaaaaactcaaatgattatatcaacagatgcagaaaaagcattcgacaaaatctagcattgctttatgattaaagctctcagcaaaataggcatacaagggacataccttaatgtaataaaagccgtctatgacaaacccacagccaacataatactgaatggggaaaaggtgaaagcattctctctgagaactagaacaagatgaggagcctactctcaccagtcctcttcaacatagtactggaagtgcttgccagaacaatcagacaaaagaaggaaatagaggaaatccaaatcggtaaaaaggaagtcaaactatcactggttgctgacgatatgatctttcgccttgaaaaccctatggactcctctagaaagcttctagaactgataaaagaattcagccaagtttccagatacaagattaatgtacacaaatcagtagctcttctatacatcaacagctaccaagcagagaatcacatcaagaactcaaccccttttacaatagctgcaaaaacaaacaaacaaacaaacaaacaaaaaacttaggaatatacctagcaaaggaatcaaaagacctctacgatgaaaattacaaaacactgctgaaagaaatcatagttggagccaagcatgttggcacatgcgtataatcccagctactcgggaagctgaggcaggagaatcgcttgaacctgggaggcagaagttgtagtgagccgagatcacaccattgcactcccacctcagcgacaagagcaaaactccctctgaagaaaaaaaaaaaaaaaagaaagaaagaaaagaaatcatagatgacacaaacagatggaaacgcatccccatgctcgtggatgggtagaaccaatattgtgaaaattaccattctgttaaaggcaatctacaaattcaatgcaatccccatctgaataccaccatcattcttcacagaattacaaaaacaattctaaaattaatatggaaccaaaagagagccatgtagcccaaccaaggctaagcaaaaagaacaaacctggaggcatcacagtacttgatttcaaactgtacaataaggccatagctaccaaaacagcatggtactggtttaaaaatacgcacatagactaatgtaacagaagagagaacccataaattaacccaaatacttacagcagactgatcttcgacaaagtaagcaaaaaataaagtggggaaaggacacccttttcaacatatgatgttgggataattggcgagccatatgtaggggaataaaactggattctcatctctcaccttatacaaaaatctactcaagatggattaaaaacttaaacctaattcctgaactataaaaattctagaagataacactggataaacccttctagacattggcataggcaaggatttcatgaccaagaacccaaatgcaaatgcaataaaaacaaagataaatagctgggacttaattaaactaaatagcttttgcatggcaaagggaacagtcagtagagtaaatagacagccaacagagtgggacccctgaccctgacccctaaccttaaccctaatccctaaccctaacccctaaccacaactctccccctccccctaacccaaccctaacccctaatccctaacccccaacctctcttaacccctaactctaaatgttgactcctaacccctaactctgaccccaacccctatctccaacccctaaccctaaacttaacccctaacaccaaccttaagcctaggttcgttactacgtttgtattgactatgtcaatgttgattattatgatcgctgtcttaggactgcacggcagcgaggggattgtgcatcttatattaatgtttttgtgtcgaggcagtgcattagcactacaggtgcttgttacatgagcaaggggggtgtcatcttttgagtgccatgtctgcattaggaatgctgcatttgtcttccgaggctgcggtgtggatctcgcactgcggccgcctcaccttggctggggagaacctcggtgggcaggattcagaggggcttttggtttcccgttttccacactgaacccttctatctggtttctgaccctgattattcagggctgcaaacaggaaggattttattcaccgtcgatgcggccccgagttgtcccaaagcgaggcagtgcccccaaggtccgtgctgaggagaacgctgctctgccttcgcggtgtcccccgggtctgtgctgagcagaacgcagctccgccctcgcggtgcccccggcccgcccgggtctgtgccaaggagaacactgctccgccttcgctgtatctccgaagtctgtgcacaggagaactcagctccgccctcgcgatgctctccgagtctgtgctgagcacaacgcagctccgccctcgcaaaggcacagcgcgggcgcaggcgcccagaggcgcacaggagacctcaggcccagactccactccccagctgtgaaagggtaagaattgagggtggctgaggctcggggttgttcagggcggggtgggctctggacccagcaggcccggcacccaggtcagggatccaggggaggccaggtggggcgaaggccaagaaggggccggggctggtcaggaagggctcctggtgaccagaacactttgcgtgagccagcgtgggaggaaggtgggctggatgagccagggaggcgccgggaggggccttggcagaggcgaccccctccgtcagcccccaggccactgaaccctgggtagcaagaaccggcaggggaggctgcagacggaggagtggaggctccttggctttgggggctctgagcagaagcatctagggggtccctcaagagacccccaaatgctgccccatggtgagaaaacagggagaggccctgcagggaccccccggggttacaaagggctgccactgtgagaaggcaacgctgctggctggggctgggctttctacctcaccaagcctcttcccacccaaagggcccagagaggggcagctgcccccccagcgggcacagcacctcctccctgtgtgatggggtggggcccacagtctcctttctcgcggcctgcctgggctgaccctgggtcccagctcggccatggggcttcggcatgtaaagcccttggggggcagagcctcccgcccccgccagcttctggctctctgtgtcgcccccagcactggactggtgccttggagggaggctccgccctcctccacatcaacccgctgaggagttctgtcttcccagggttgtgagggaaaccagctctgcaggcctatgtccaagtctaggcaccgcctcctccagggagccttccagacctgatctgtgtggcagaggcccagaaggacctgggtgtggggatcctagagggaggcgggggacccagcgtgaggagagagggtcccagtgcttcctcctgagtgagggtcacccatctgactccggctgcacagagccactccctctaagcgctcctgctctctgccttcctgcattagctcttgcctgtacccggcccagcaaacccctgctcatctttcagacccaagttcaaggccccctcccactccgggtggctcatcacctggcctccccaggcagagaggctaggctcctgctcactggggcgtctcccttgcccactggcacgggactacaaggaaaggggttgacccccaccctcccccgccatgcccaggagggtgcagacacaactgggaaggtgctagagaccccggggggaggctgggccagcaccaggcattggggggcaggttcccgtctctacaccccagccccaggcggacagcgcgtgcccctcccgctgccccacctgtcacccacctgctggccccgggctgtctctgctcctggctcccctcccagctgcgtccccagctgcctctccagggaggagtgacagctggcctgtgccacaccctcgagcccccccggactaccccctccctggggcaggacccctgcctgtggcacaaccaaggggcctgctgatgggggctcatgtgagcagtgcctcagctgtgggtgtgggtgctgccagctgccaccgcctttgccctggtttcccagatagaccccgacccacactccgaagctgtatcatgaacgctgtggtgggcggctggtggggagcggggttgccgtcccactaccctctggaagcctcagccatgaagagcccctgtgggcaccttttcccggcacacggtgctgtgtttctccactcttgggctctgcagtgacttgaggggtcaagtctatgatcccacgggaggctgggctaatgaggggaccagagacctcagtgctgtgcagggagtcctgaaccaccctggtggaaggcccagcccaactccccagtcctcccgccagctccctgtggtgtccaggagacctgtggtcaggcctggaggagaagctcctcctcccctcgacatcctccctgcagcccttgctcttcaccagagcctcctgactccccaggaccccagagaggactgaccctctccagccgacctctgggctcaggacagctgggcggggcagccacaggagctgcctgtagggagcagagtcaggacggggaccgagccggacacccattctggaagtgtctgcacttccaggcaggggaaggacggcagtgggtagctgggagtgctgggccgaagatgggcattgtcaggccctcagtggggactgggaggtagaggtggggaggtctgtggaggaaggagaagaagggccagtgtcccgagttgggggtggttggcagtggacgaggccgacaggaacagacctgagcttggggagctccactcagaacgaggcatccttcagggttctgtgcatactggtgtccctggctgggggccgggccccgaagtggagcctgggactgtgagggtgggggggtgtgctggggtgggaggtggatggagccccccccccaccgcccggccgcttgggctgaaccttggacttcggagccggaacagacataggaaatggcctaactgcatttgcgcaggaacaccaaatccctcgcagctgcacggggctgagccagggccacgggcggggtcggccatcccagagtcctgacagctccgtggtgtatgccaaggggcctgggccgctgaccgaggggcgcctttcccaggccagaggcccccaccccaccccaggagagctgcccccctttcagttcccagaacggagcccggctgtggaatagtgatgcggtgaggtcatggggagggggcccgcatgactcatatcctggggtaggggaaagggaggagacggagaaggggcccagaggcctccacgtcctcagctctgctgggtcagaggccaggggctggcggggcttctccccagcactgggttttaggggagacaccaggagatgcttactctgcatccccactctgtcccccaggcccctagccagggagagctcagtcagagtgatcctccaggggcccagctctgcatggatgttcccagagtacacacctgggcctcgtgccagggccggcaccgccgttgtcagggctatggcaaggcaaacagtcaatgtttgcctcactaaagtgaggctgcagcaccctgaagggatccctggagggggacgtggtccccttgttcccaagcttgtctgcacatgcacgtggatgtcaagggttcccgtgtgtgagcacgtgcatatttgtatgtgcatggggtgcgggcatgtgtgcctgtgtggccggagcgtgggctcgtggagaatgtgtgtgagttgggtgtgcacctgcatgtgccccaggcctagggagtcccgcgcccggccgcactccttgtgttgggcatgagctgtgagcagagtgagggcctttatggggctgttggggcccggactcgttgcccttaggggtggacctaaggaaacgtgtgcacacgggcttctggggtctctgtgccaatgtgtgcttccaagccacgcctcccctatggcttggtggagggggtctgtggagctggagtgagggccctggacccattggaagcccaggtccaaggaggagcttgggctccatctcatgccccaggcccaaggacacacaccccagctgagaccttgctcacatagaggggctgggacatgggaacatggggagcaacatggccaggcttctcctccatggaaaccctccacctcctcaatactctgccccagctctgcgccgccctccatttggaggggctgggtcgtgagtgggggcgtgagtgagcatgagggcccctgcaccccaggctctgcctccccacgtggaacgaggcccagcagcccccagccaggtggctactactgcattcaatcagtgcccctccatctaacaaatactccctcatataatcagtactcctccatccaatcaatattccttcatcaacacctttctatacaaccaatagtcctccatctaatcaatgctcctccatccaaccaatactctgcaatttaaccactgtccctccatccattcaatgtccctccatccatcccatggtcccccagccctaccccatgagcagcatggaggcagacccacatctgtcttgtgcgccatcatctccctgatgctcttcaggaaagggaggtgtctcacaattgcattgaatggaggaaggcacatctttccagtgatccccactctagggctgcattgggaaatcgctcccagggaaaacacaaacacaaagcagagggttgcccagtgtgaccctctgatgtgaccacggtggctgtccactaaggtaatcctgatgcttttcctcctctgcagactgctggccagacccccaagctagcccgccaggcctccatagagctgcccagcatggctgcatccagtaccaagagttggtgggagacgggtgaggtacaggctcagtctgcggccaagactccgtcctgcaaggtaaggtcccctccaggggcaaggctgggctgcagagccagcactggggagtttagtagcaggccaggtttccttgttaagacaagcgtgggactgtccaggatgaatgtgggcagacagaaccctgaggtattgcagtagggttgggttcacccttgctggtgtagaaggctgtgttgtccgagtggaggtggatggcacctttattcctttccctgcttcttccactgggatcgcacagaaaaagttttggtaggcagatcccaggccccctggccaggtaaggcaaggcaggagagaagggcccagggcttctactccccaagatccaggggtctgcccttgtgacatacccttctgctgcccgcaggatattgtggctggagacatgagcaagaaaagcctctgggagcagaagggaggctccaagacctcatcaacaattaaggtagagcctaaatgtggttggtgcaggcaggaaatattaacttatttcattgtcacacgaaaccagaagacataaaacagttaaaataggccaggcacagtggctcacacctgtaatcccagcactttgggaggccgaggcgggtggatcacgaggtcaggaggagaccatcctggccaacgtggtgaaacttggtctatactaaaaatacaaaaaaaaaaaaaaaaaaaaattagccgagcgcaggggcacatgcctgtaattccagctacttgggaggctgaggcaggagaatcacttgaaccagcaagttggaggttgcagtgagccgagctcgcaccctgcactccagcctggcgacagagggagactcagtctcaaaaaacaaacacacaagcaaataaaaaaaacaaaacaacttgacacacttagaaaatgaaggtttgtgctattggttttcttttattttagaaaaacaaagcattgtttaaatatttcttacaagtacaaatataatttaaatttaataaatgttcaaaaatatctgtaattaagtttcattcagcagacatatgtctaatagagaacttgctaagtaagatataaaggatgattacatgaaaaaatcacaaaattgtcagtaagagtcttaaaagtcagtgataggacagtagttaaaagatatcaaatagttatttattcttaaacgttaaacaggatattaatagttttaataatcttgaagtttgacaacactgtgaaaacattacagaccacttttatttatgaaaatacgtgcaaatagcaaacaccagttgggcttaaggctgctacttacttacccagtaagtgacaaagctggaattcaaaccaggtttgagctataccactactacccttgaaaaggtttcattacactcagctttccttaatttcttaaactctttttttttttttttgattgagacagaatcttgctctattgcccaggcgggagtgcagtgacatgatcttggctcactgcaacctctgcctcccagattcaagcaattctcatgcctcagcctcccaagaagctgtgattacccgtgtgcgtcaccacacctggctaatttttgtgcttttagcagaggtggtgttttgccatgtcagcgaggctgatcttgaactcctgacctcaggtgatccgatccgcccgcctcggcctcccaaaatgctgatattactggtgtgagccaccactcctggccaatttcttaaacttttgattatactaaatatggtccttctgcgtgataacactgtttttccttttataaaattaatctcttaaaatactttaaaattcaaagtacactttttagattctttaaaatactctttgccatgttcatggcctttagatgtgtgatcatagcctatttgcttttcattgacttagtttcatatttctttgcctttttccccctacttttccttatagaactatttactagtaatgaaatcattttaaagaatacactttttattccacctgctaactgttaagagaatgttttataatcactctggtcatggcctgtaagtttcttttctaaactatcttttcaggatacatatttactaacttgctttcaaatgaatatggtcatgtctatgcagcaagtttcttttctttcttcttttcttcttctcttttttctttttcttttctttcttttttaaggcaagatttcgctctgtagcccaggttgaagtgcagttgtagaaacatgactcactgtagcctcaacctctctggctcaagtgatctgcccacttcagcctcccagccaagtagctgggactgcaggtgtgcaccaccctgctccactaagttatttagttttttgtagacatggattctcagtgtgttgcccaggctagtcttgaactcctgggctcaagccatcttcctgccttgacctcccaaagtgataagattacaggcttgagacattatgcccaacctctttttctttttctttctttctttcttttttttttttttttttttgagacagtcttgctcttgttgcccaggctggagtgcagtggcatgatcttggctcaccgcaacctccacttcccgggttcatgcgattctcctgcctcagcctcccgagtagctgggattacaggcatgcaccaccacacccagctgattttgtattttttagtagagacagggtttctccatgttggtcagcctggtcttgaactcccgacctcaggtgatctgcccgccttggcctcccaaagtgctgggattacaggtgtgagccaccattcctggccctctttttctttttaactaagcttatttatctcttccccagcttgagtctgggtcctactgtcttggtcagagtattttactatattgacctggacaattctgccatcatgaaccatattccaaacctaaatatgtaagaacatagaaagattattttagcaggagaattttaacacacacacacactttattctgaaaatttagcaacaaaatgaaaggtgagttgtggtagttgatgtatcaacaaatagaaagaagaaagcctgtaatctgtttcagaatgctatttctggggctggtaacatcaaaaataatcaaattaagtgttaacttgctgactcgtaagattttctctaatttagaagttggagaacatatatactcctattaccactttccatctttctcaaatatagtttttatagttttctgttggcttcatcatcgtattgaaagattattaatcacttacatatatgtagttttctgttaagtcctgttcaatatattacaaaattttgatctgtgtatgtaatatcaattaataagatggtgttagttaaatcagattacgtgttcattcattaagtcattgttaatacttcacagaatataaatcgtgttccatgagcatgaatttctctctgaattccacataattgtcttaaaattatgcaccatttattgttaagagtgaaagattatgtgtcatttattgtagtggtagaagaaaataaaaccaaaacagaatccaatccaaaagcttaggtttttgttgctactacagtaattacatcttcatatacgaaggacagcacattattactgtccaagaatggtgcctcggacaactggttgcttacactgttttcagagatgaaataggaacataagcaggaagatttttgtctaaatatgaagcaagaaaggcttaaatgtctttattcaggggattaggcatcataagtttttttttttttagagaaattgttttcatgatatttcctatctccttttgtcactttgcttttgtcggtaaattttacaactaaataaggattaccaggcataaaaagcagcagacaatcatgatgcaaactgaaaataatcaatcaaaactgacccagaacttaaatagatgttaaaattagcagaggaggacattaaaactgtttttatacatgtatctcatataatcaaaacattaaatagagacatgggagataaacaagaaaagccaaaatcaaactttcaaagacaaaaacatttgagatgaaaattacattggatgaactaaggcagattagaaactgcagaagaaaagattagcaaacttgaagatacaagaacagacactagctaaagtacaaaaagaaaaaaaaatgttaaaaagtgatttttaaaaagcatcagtgagcagtcaggcaacttcaaatggcctaataatatgcaggtaactggagtccccaaaggagaaaaaaaagaaagagaaaaaaaatacttgaagaaacaactgctgaaaatgttctagccataacaagacctattaactcacggatccaagaaactcagcaaaccccaagcacaagaaacatgaagaaaattacactaagggataacataatcaaattgttcaaaatcaaggaaacattattaatagcaggtgtataaaaagacatgttacctatagaagaacaaagataagaacaacatcagatttcttttgagaaacaatgcaagtgagaagacagcggtacatctctaaagttctagaagaaaaaaggccaactagaattctatgcctagcaaaaatatctttcaaaaatgaaggtgaaataaagacacaccagaaacataaataatgaaataattcatcaccaggagaccttcactgcaagaaatgttaaaggatattcttcagaaacaaaatgatgtcagatgaaaatctggaccaatacgaaggaataaagagcaccaaagtggtaactatatgagcaaacatcttttaaattttttattatttaaatctctaagagatacatgtttaataaaaaaacagcaaaatgttacagagtttataacatatgtaaaagtcaaatgcatggcagcaatagcacaaagtgcaggagggaggaaaagaaagtaaatgaaggaatgcttttattatagatgaagtgtacaatattacttgacctctctaaatgtgcactataatcttaaaggaaccacaaaaataatttttaaaaataggtaaaagtaataaaaagaggcaaactggaatcataataaataatgtaagctgggcacggtggctcacgcctgtaatcccagcactttgggaggccagggtaagcggatcacaaagtcaggagatcgagaccatcttggccaacatggtgaaaccccgtctctactaaaaatacaaaaattagctgggtgtggtggtgcacacctgtaatcccagctactcaggagactgaggcaggagaatcgcttgaacccaggaggcggagactctagtgaaccaagatagcgccactgcactccagcctggcaacagagcgagactctctctctcaaaaaaaaaaaataaataaataaagtaaaagcatgcaagaagaccaggtgcaatggctcacacctgtaatcccagcactctgggtggccaaggcaggagactcacttgagctcaggagtatgagaccagcctggacaacatagtgagaccccatatataaaaaaataaagtagccgggtatgatggtgcacaactgtggtctccactattgggaggctgaggtagatcacttgagcctagcaggtcaaggctgcagtaaggtatgatcacaccactgcactctagcttgggtgacagagcaagaccccatcttggcaggtgggggatgcaagaaaaatgcaaggaacagatagagataaatagaaaacataagaagacaatcatattaaatgtacatggtctaaatacccccaattaaaaagcagaggttttagaccatatacatttaatgtgattgtcttcttatatgtttttatcagagaaataaaactatcgccttcaagaaacacaagttaaatacaaagatgcaaacaggttaaaataaaagaatggaataacatataccatgcttacgctagtcaagagaaagctagaatagaaatactaatatcaggcaaagcatatttcagagttaaacacaacatttttccactatttgcagtcaaaagtatcgttaacactctctttactctgctcaaagttacagagttcttttgtataaacattagaacacttatcacagcctgcctataatggagaataattccatgttgtatactatacaacactcttactaaagtccattagacagaaatatgtagcatttgagacatcttccaattataaaactctatgcaaacaaaaattaacaaagcagttctgagactattatattatcctgtgaaggagggtctgtctgtctgcacagttggtcctaggctggcttctgaggacttgaatttcaagagggttccataactggtaatcatggtttactgtatctagactatggaaataatgtggcttatcctgctattctttttgtgagtctggaaatttcacacatgctaggcagagtacacatatgtgacccagccgagataaaacctgtgtttcttgggaagtcacataggttgttgtattttcattaagggggaaagaaggtagtctgtgtgatcctcatggaaggcacagcacataaggaagccggtacatggatttttccagactctgtcagtgtcttttgccattgagatctttctactatatatccatactatgttacagtaataaatcttagccattacaaccctaagctgatcccatgagtccttctagcaaatctccaaacatggaggcagtcttgtggatccctgacacaaatatagtgttgtgatctcttaaggtttatccttcctcttaaactataaagagctggctgggcacagtggctcacgcttgtaatgccagcactttgggaggccgaggcgggtggatcacgaggtcaaaagattgagaccatcctagccaacatggcgaaaccccgtctctactaaaactacaaaaattagcagggcgtggtggcacacatctgtagtcccagctactcgggaggctgaggcaggagagtcgcttgaaccagggaggcagaggttgcagtaagccgagatcgcaccactgcactccagcctggtgacagagggaaacttcatctcaaaaaaaagaaagaaactataaagggctgggtgcagtggctcacgcctataatactagcaccttggcaggcccaggtgggagaattgcttgggcccaggaattgagaccaacctggacaacagagcaagaccctgtctcttaaaaaaaaaaaaaaagaaaagttggccgggtgtgatggatcacacctgtagtcccaacactttgggaggccgaggtgggcaaatcacaaggtcaagagttcgagaccagccaggccaacatggtgaaaccccatctctatcaaaaaaaatacaaaaaattcactgggcatggtggtgggcacctgtaatcccagctacttggaaggttgaggcaggagaatcacttgaacctgggaggcagaggttgcagtgagctgagatcacgccactgcattccagcccggtgatagtgtgagactccatctcaaaaaaataaaaaagaaaagaaaagaaaagttagccaggtatggtggcatgcatttgtgatcccagctactctagaggctgagacaggaggactgcttgagcctaagaagtcaaggttgcagtaagccatgatcatgctactgcattccagcttaaacaactgagatgctatctcttaaaaacagaagtagaagcaaacaactataggggaaaatgagggatacatactttaagaatttttaaaaatttacatggaaaaacaccaggattctatagaaaataaaacagtattaaataactatttataaaatagatactagcaaattaccttacgtaaagattcaagtcagtaacttaaaggatcttacataaaagtactttccgttggttggaagagagatttttactatacactgtttttcaatttttttagacaaattacatttaaaagtttaaatttgcttatctacattcttaatgtgaattgccaccttactataggaaggctatttttgttcctgcagtctacaaaaagaacaaaaatattaaaaacgtacaactcttctcacagaactaagttggttttatacaaagacatctggcacaaaatacaatgatatttcaatatagaattacagcaggggatgagggtggagaaggaagagattgccagttctaagaggggagacaacagaagtatttttttaatgtcttattttaagagtaaaacacctgcttttttttgagatggagttttaggcgggagtgcagtggaacgatctcggctcactgcaatctctgcctccaggattcaagtgattctcctgcctcagcctcttgagtagctgggattacgggcacacgtcaccacgccaagctaatttttgtatttttagtagagagggggtttcaccacattggccaggctggtttcaaactcctgacctcagcctcagcctcccaaagtgctaggattacaggcatgagccaccatgcccagccaacactgaacattttgttcagaactagttaagaaaacagaaatatacattgggggtttatggattacttatttttggggtgcaatactgggaatagaagagaaaggagcttcctttccctctccttctttcattcattcattcattttgagaagaagtcctgctctgttgcccaggatggagtgcagtggcgaaaactcagctcactgcaacctccacctcctgggttcaagcaattctcctgcctcagcctcccaagtagctgagattacaggcacgcaccaccacacacagttaatttttatacttttttagtagagacagggttttgccattttggctaggctggtctccaactcctgacctcaggtgatccacctgcctcagcctcccaaagtgctgggattacaggcatgagccaccgcacctggccaagaaaggagctttagataaataaaatgattaaacatttgtagcatgtagaatgaaactattcccttagtaatactcaaattatccagatttccaagatgttggtagcaccccgagagcttcaaaagggaaattaaaagaaaaacgacgttacccttcctgaaacacagattcactgtttgccatattcttttctctagtaaaagatgaatagtttcccctggaaaaactaaaaacaatctgaggtatatttcagagaaaacaaaattgcttgataaaaatgccatgttaacaactgaggaaattgttttacatatattaattttaacacaggaataatatgtcaaaccaggatttctcaacctcagcactatcgacattttaagctgtatagtttttggtgtgggaggctgtcctgtatattgtagaatgtttagtggcagccctggcctctacccaaggggccagtaggacctacctcctcattcaagctaatgcactaaatttttcccttcattgacaaatcccattaatgcgtgtatttatcccattagttactctcttgtgttccaggtactttgttaggcaccagagaaaatatgataaagcaaaacagctattttcctcactctcatggtgcttacagccatggtgggaaaaatccataggaaaagactcacatacacaaatgcaggcagaataaaaaaactcacacaaacaaacgttgcagatgttgttaagttacataaaggagatatgcatggctgtgcatggtggctcgtgcctgtaatcttagcacttggggaggccaaggcaggtggatcacttgaggccaggagctcaagaccagcctggccaacatggcgaaaccctgtctctactaaaaatacaaaaattagccaggcatggtggtccatgcctatgatctcagctacttgggagactgaggtgggaggatcacttgggcccaggaggcagagggtacagtgaactgagattgcaccactgcaatctcagcctaggagacagagagagacgtctcctgttctcctggagaacaacaagtcatgatgtcagacaagaacttggattttggagacacgggtttgaatttcagtcattcattcttttattcagtaaatatttagcaagtactgacatgtcccagatgttgttttactcactggttatacaatgggagggagacagagaaagagggagagagagagagagagagagagagagagagagagacgctattctaaaagcttgaagtctaggctgtgcagagtggctcatgcctataatcgcagcactctgggaggctgaggcgggtggatcatgaggtcaggagattgagatcatcccggctaacacagtgaaactccctctctacaaaaatacaaaaaattagctgagcatggtggcaggcgcctatagtcccagctactttggaggctgaggcaggagaatggcgtgaacccaggaagcggagcttgcagtgagccaagatcacaccaccgcactccaggctgggcgacagagccagactccatctcaaaaaaaaaaaaaaaatgcgtaaagtctagatagactttaacccaggaataatccaaggaaatgaacaattacgaatgtgacaagggctgtgaagggaaagttcacagccttatcgaagtgtacagtagttggggaggttggccaaggcaagatgtttaggaaaggctttcctggggaaatttctctttgggttgaatcacagttaagtaggcaaaggggaagacagagggaagggaagtatggcaggcaggaagaataggcacttaatagctttgggatattgggcaggtcgcttgatctttctgagcttcagttttctcatctgggaaatgagttaataatagtcgtttagaaagtgtgatgagaccagccaggtgtgatggctcaggcctgtaatcccagcactttgggaggccgaggcaggtagatcatgaagtcaggagattgagaccatcctcgccaacatggtgaaactctgtctctactaaaaatacaaaaattacccaggcatggtggcgtgtgggaggcagaggttgcagtgagccaagatggcaccactgcactccagcctgggtgacagagcgagactccacctcagaaaaaaaaaaaaaggaagaaactgtgatgagatcaaaacagttaatgcatgagtgttctgaacctcgtttctccctctgctgtatctatgcagtttcttgacctgggctgtgctccaaagaggattctagcttggcttttgtgatagaggatggatacattattagacctgaaaagccagagcagggaggaatggtcccaaaaggaagaaactgtgcttgtcttcacaataaagagcagagaagtgggagaggtattgaaagctgtgggtggagttttgcaggtaagattgtgtgaaagaggtgagggaactacaatctaggggaatgtggataggagagtaaaagggaattctagagaacaatccctactgacttcacacaacttaagaaatgcaagtaaagggccgggcgcggtggcccacacctgtaatcccagtactttgggaggcagaggcaggtggatcacttgaagtcaggagttcaagaagagcctggccaacatggtgaaaccgcatctgggttagccaggcatggtggcatgtgtctgtaatcccagctacagaaagatagagaggtggctgaggcaggagaattactcaaacccaggagttggaggttgcagtgagccgagatcacaccactgcactccagtctgctggacaacagagcaagactcagggggtggggtgggggaaggaaagaaggaaggaaggaaggaagaaaggaaggaaggaaaatagaaatagaaatgcaagtaaagaatttcagtttgaaaattgccttttgtctactgaacatgagactgcttggaaactgggcaacgtggatttttataagttgtacaaagcacttagcaattttcaaacctctccatcctgcagagccagctcaatcacttctccagaaagacttactgagtcctctgcactgaacaggtgtcctgtgctccaggagagccctgggctggctcctagtgtagccattatgaccctggaatgcaccatctttcacatcactgcctggccttctagaatctcagcttcttaaatcaggaaattgtgtcttgttcatgtctgaattccccaagtgaacacagtgagtgggtgcttgacaaatctttgttggtaatgagcaaaaaaggggattctgtgcccaataccatgaaatcaatgcacagaagattcaatcaatcaagaaaggtgcacagacgctggccacacacactgacatttgttttcagatgttccagtccccctgacttccaccaacccattcattcattccacaagcatttttgctggggtggaagcagggccatacagggtgtgtaagtaacagatagggtgggtttgtataatgagtataaaaaacttctagcagaagatgacaaagtatatcaagaaagggctctcttcgaaatcacaccactgcactccagcctgggtaacagagggagattccatctaaaaaaaaaaaaaaaaaaaaaaaaaaaaaaaaaacagggatgggggcaagggagctctttttttccagttagcacaagattgccatttcagctagggattctactgcaactatctcccagaccctattctagggcccggggatagaaacagaatcaaaaacatattccttgtcttttttgggcttatattattgaggagagagaaataaacaatttcaaaataaacaatgtcatacagtgctaagtgctataaataaaatcaaacagaataacgaaagagaaagtagctagactggagggaaaagctgcttcagaatgagttgtcaaggaagcctctttgcaatcagaaaggtgagaaggatttagtcaggcaaatatcaggagtaaattattcttggaggaaagtaagcccatgcaaaggccctggggcagagtgggcttatttgataaagaggtaaaagggtcaggatatctgtagcaatagtggccaagggagggagaggtatgagacagaggaggtgagccctgttgccatggtgagggcatgaggatttattctaagttccagatacctggagttaaagtcccctgaactggacaacaactacaagccttcatatctcaatgctaccatctttaagcccctgttataagagctcagaggcttcagagatgacaggaaacaccagaacgctatggtggagcatatctaggtgccttctcccaactcagatcctttgactatagaaagacacagatttcaaggctgagatccacaaaactctagcaaatactgcacagacactgaccaatgacagcaggtgctgcctgtcaccctggagcaccaggcagggttccaaagcacccttgctgtgccagcctctgattgctggttatagggaggtctggggtagtcccaaaagctgggatgtctaaggcagctggggtcagtcaggaggctcagggcagtggcaggaaaatattttcctccctggtagagccacagcggggtatccaggctgaatattattggcgagaaggaccatggcacagcaccaagacctgcaggacaaactttgttggagctgaatccagaaaaacaatcttcttctaaaccactctcctgcccctcatttaattattgtgcttttgggtgcacttggactactctgaaacattcagaactctgtcaaaaaaaaaaaaaaaaagacctctctcctcagcacctctcccacttgggcatcagtcttggcttcctctctacttgctttcacttgctccttgtggcagagattgccctcagcagatcccttcccttaggttccttgctgtcaagtggaggctagggagcgagattatggccaatagaatgtgggcggaaccacagatctgagcctgaggaacatcccacaggaccctgagctcttcctccagctgctgcagtggccttggaagccatgtctgttctagaagtgtagctacagatggagaaggcccatgtgctagctagtctccaaagatggcgtatcaggccattcttgcgttgctataaagaaatatctgagataagttaatttataaagaaaagagtttgtattggctcattgttctgcgggcttcacaagaagcatggtgctggcatctgcttggcttctaaggaggcctaggaagtttacaatcatgagcaggcacatcatgtggccaaagcaggaacaaggaagagagagtcggtgggtgtggggagggacatgccacacacttttaaataaccagatctcacaagaactcactatctcaaagacagcagcaagccatgagggatctacccccatggtcaaaacaactcccaccatgccccaactccagcactggagactgcaatttaacttgaaatctgggtggagataaatatccaaattgtatcagagggccttccctcgaaccaaacctcctggtttccaggtcccctttcttgctgcttctgggctggcctcctgggaagccaagactgcagtggctctgatgctgcatgggggctgaggctcagccatgaggaggctcgcagctgccactttggtcttttggaaactttgctcgtgagagtctccccgttgggccgcagccaccatgctgagaaataagggtcatgtggagaggccacatggaggttttctggtctagagcacaactgagctcccagaaagcagccagcatcaatggctgggcatgtaagccagctggcatggacattccagaccagtctgtccttttgtcaccttagctacagggaaggcccatgaccccagaagtgcccatcattatgctgaattcccgagcctcagtggtccaccgaggtgtggaagcatgtctcacaagggtcagatggagttctggcctggattgatgtgtagaagctggagagagaagctgggtttctttcagctggggtggctctgctgggatgtggtgggccttttgggtttccaggtggtcattttccttatttgcagtagaaggaacgaggcccatatagagaatagagcaaattaaaaggagagaaagagaaaaaagtaaggagagagggagaaagagaaaaagaaggaaaagaagaacggagggaaggaggagaggaaagaaaaagagaaggaaaatgagaaggaggagaggaagaggagagagagagagagagagaaaataacttacttgaacctccaaattcaggcataccatggtctttgcagttataaaaatcaataagtcacccttcagctgaaacatgtctaagtggagtttcagttgttacaactgacagagccctgcctagcacaaggaataaacaatgttcagcagtggcatgagaacaagggacagcctgtttggtgggcagcatggcaaatgactgtctggaaaatatgatgcttgggctggagggcaaagtggaattcaccagcatgcagggtggaagtacgaccctagcagacggaacagcactggcaaaggctcagaggcaagaagctttacatgtgaaaggatacatttttagaacactaaacattctccctgttatccaaaacactgagtttctcttcattttttggccaggtgtggtggctcacgcctttaatcccagcactttcggggctgaggtgggtagatcacctgaggtcaggagctcaaaccagcctgaccaacatggcaaaaccccatctctactaaaaatacaaaaattagctgggtgaggtggcagacacctgtaatcccagctactcgggaggctgagggagaagaataacttgaaccaggagtcagaggttacagtgagctgagatcgtgccactgcactccagcctgggagatgagacagagcaagactatctaaaaaaaaaaaaagactgagtttctcatcattttttgaaattgagagttttctctgtatcgataagaccttataatgcaaaatataatataatatgcagctaggtctccacagccttcagtctttcccagggagggttccatgagctgcttgtctggtggggatggtggttttgagcaagtagttggtgtcctgtcttacccaggctctttcccacaaagagttgggaagaattaaaaactactggaaaccaagatctctccctgatgttgactttcagagctcagcctcatcagcacaggctctaatcagctaagcagctgcctcgtttcatccagccagagccctgatctcaggggatgatagtgaggaaatgatcctttcacatgcctggctcctgcaaaattgtgctaagaggattttcctcaaacagtttagcacagagcgaggtttcctgatccagttagcaaatattcttctgtttgaactcactgaccctcctttttctgaagatgtattttaaattggatttgcttcactgacacaaatggaaaacttgataagaaaatcggtgggattttgctgcacccactgctgatatcaagactgaactctgtattatagcaagaaaagctctgttctgtggctacaggatacatgctgagctcccagccaccagccctgccaatgtgctcagcttggcacagggcagggagcagggtagaggggaggggatggggaggggcaggtggaaaggctcaggtgatgagccagccacatcacctcaagcacaggacccctgatggtggccctagatcctcctcttgaaatccaaagctcagtccctctccccagttcaggagcaaggaggtttctggcaggttaaaatggctaactcaagagcttgccacctttgaaaggcagcactgtgtagacagaggcagaaggatgggcttacgagacagtcctggcttcaaatccttctctgacttaccagctctggaaccttaagcaagtgacgtaacctctctaagcctcagttgcctcatctttaaaatggcatccctaatccttactatgaagagatatcatgggtaaatgagatgctgtacttacgaaagggcaagtccctgtattggtcaagtgtttttacagcattgctgcataacacacagccccaggggctcagcagctcaaaacaagtgtttatttcttgctaataatttgcagtgagctgggaagccttgcctcggactgggggccaggctctgtttgcttctgtgtgtctcattcacaggccagtggttccccggagcttgctcttctcattgtgcaggggtagggtcagtgctgccacccaacaccacattcagttagagcctccagtcagaccaggcatgcactaactctgctcatgcatctctagccaaagctggtcatgtgcacagcaagaaatctgctctgtcctgtccacagggaagtcgcaggaatgtggaaaggccaggaaggattgtgagccaataatacatcttgacaatccacaatagatggaagctattattgattcattatctcaaaatggctccaccagccaaccccttctatccatccccagtgctacctcctaattgaggtcctcgacgctttttgcttgcatggctgccagagcctttgggcaggtctctgtgttgatgtgttcacccccactcctatctcctccatccaacgctctaccaccaaggcaatcctcctaaaacacaaccacagtgttcttcacactccctatgattccctgccacccacattattaatcattaatccaattaataaaaattaatgtactaatccccagctcctcagtgtggcccttcacaatctgcttgtccagcctcgtctcttgcctccccagctttccccagcagacccctctcccacccattccaatgccatcctcttctcccagcctagttctttcaggccctgtgcgtttgcacttgcccctgtctgaaatgtccttcccacttcttcttgaagggggtgagtgccaactcacctttccaaccccacaccaatgcacaccaggatctccccaagactccagggtagtagtcaccatctgtatttctgcagcacactgcacctgcctctagcacagctcgacagcccactgaagtgaatgatctgttcgatcggtgccgacttgcctttctttcccagctgcaaaccacccaaggtgaagtcatcttagcctcttggagtcagcctgactggggtgaacccattgatatgtattgcataaatgaacatatcatgacagtagtgatgagggatctccagctatccgtgtactctctatgcttcccagactctttggcagttgcactgggtactggctgagttctggaaaacaggaatgtgagcagagtgctgcagatctccttgtcaggagcacctaagaactggcatgactctacaccctctctccttctgcaatgacctcgtgtcaagatggcagacccgcagagatgaatgtgcctggatacctgagtcaccaggtggaggaaactcccattgacatgcatcacactccacatatgaaacccttctttttctgcactgtcactggggttagggattattactcactgcaacttagcctagcattaagttgcttgactaatacaagtttcaataaatgtcgcttcatttcccatggcttctgactgaatgctgtgcaatatccacaaaccatccagattgtggtttataaataccacccttcactaaaaggactcagagctccttgtagaaatggctgatgctaaggctggggtagggaagtacaaggtgagcccagagtgctgtgtggtgccagaaagcaaggaagcatttaaaaaatgacagggacatgtcaaaggacacatcaatcaacttcaaggggcttccactggccaaatctaggatgatgtgagcatccaaattaataatgataatggtagattatagtctattgaataaaatgggaacctatagctatagaaagaaagaaaagggaaggaagaaaagaaagaagaagagagggagggagggagagagggagggagggacggagggagggaagaaggaagaagactttcttacagtagaatgccaatgaataaatacagagggaataatagaaaactccatttgcaaacatgatcataatagtttattcaaggaagaatcatcactgagtgaaaatttaggaaggtaaagtatgttttcattgtctcatagcacttccactcatatggtttattaattgcaaagagaaaaagtggtaacttaacagtagagaaacccagcaggtcctcccttaatgagctgaacaaagttaacaacaccaggaataggacaaatgggtgccaagtgtttcttgatgtgatacactgagaacacagcattgcttctgtagcattccggtccctggaggaaacatcagacaaacacagatggagggaccttcaaggactgacctgaactgttcttcggcgtcaaccccatgatagacaaaaagaggcagaggaactgttccagattaagggagactaaaaaggtatgacagctggatcaggggaaacgtgccttaaagggcattattgggactgttggcgaaattttaagtgaactgtatattagacaattatcaaggactacacgattgtatggcatcaacctcaaattccccgaacttgagcactagagtcttcttgttctgatggaatatgttctggaatgtttaagggagaggagaaggatgtctgcaactgaatttcaaatggttcagggaaagataatagagtagaatagactatatagatggagaaagtaaatgtggcaaataacaattggtgaaggtgggtgaaggtcatgaaagttctttgccttacaattaattcttctataagtctgaaattatttgaaaataagagaaatgctttcagctgtgaataacagaaagcctgactacttgtggcttttgcaataaagacatttagttatgtaacataacaggatttaagaggaagaaggcaaggacttgaaaaggctcagtgatgtagctgaggccccagattccttttatcattttgtccaaaggctccaccttcctgaatattactgctttatacccttggagcttcatgatcacaggatggctgttatagctccagccatcatgaccaagttcagactccaggaacaagatggaggaagctatgtcaaggggggcttttcttgatgtgtctctcgcctttaaccagtgaagaaaatcttcttagaaggacacagcagacttctccttatgtctcattatccagaagtggaccacaggacagtccctactgtaaactctttcaagtatcaggcaaaaaggaacaaaaggccccagcctggcttaaaccaaccttgagtcatcacctgacactggacactttgtttatccaagcaaaatcaggattttctgttagcaagcaaaggaactgctcatgggtaagaaattaacagtgtgtgccataattcatatttgtcgccaagcatcttctcaggctgacactgtgccaaacaagggattatagagatgaagatgcagcttccatccctgaaagctcacagtccattctctcagggcaatcccggtaacctcctcatcacaatcatccatccagatcatggaagtccctttactccccaaataagaaggagtagcaggaaaaagtgacctcatcaagctgactcgagtttttccaaaagcaaataaataaataaataactttttaacctgcacagccaaatatcaaataaatacatgtgtgttttttgggggggttggggggtgtttttttttctgagcttcctgtggtattgaaactatctcccacttcctcctttttgtctcaaaagatcttaagcattgggccagacacagtggctcctgcctgtaatcccagtactttgggaggccgaggtgggcagattgctttagcccaggtgttcgagacgagtctgggcaacgtaaaaatagcccatctctaaaaaaataaaataaaataaaatacaaaaattagccaggcatagaggtggatgcatgtagttccagctacctgggaggctgaggtgggaggatcacttgagccccaggggttgaggctgcagtgaaccatgatcatcacatctgggcaacagagcaagaccctgtctcaaaaaaaaaaaaaaaaaaaaaaatctaagcatccattcattttagttcatttgaggataattattgatctcctcttctaccaccactagggatacagaggaggagcaaacagacattattcctttctcttgaggctcacagttaattggtaaagagggaccactattcagaaagtcccacacatcattgtatgatcaaaagctatgacagatgcaaggaaggaaagctggatggtgttgtgaggcttcatggcagggacaccagacctggtctagaggtgagggaagacttccctgaggcactggcttgaatggagagctgaaggaggaataggaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctgctggtggtgttttgttttttgtctctaaatatgtgatttagccataggttgatgaatatttttcttggttgagaatttcagaatggcattattattcttaacaaataatattgtttattttacctttcatgctttcagatttcaatatgattaaaggtaatttgatttttctagtgctaattgaaatatttttcccttcctgattgtttactatttctctaggagatatgtagatgtaggtttatctccatcgtagcttgcttagcatgcatagaagttttgaatatgtggattagtgtcttacaaaactctagagaactttcagccaaaataccatcacatattgtcccttccccgttcccttcctctatgagaacactcactaaacacatgctacactttctcactgtatcttccatgtctcttcatgattctgtccacattgtgcctttttttaaattttctgtaatgtattctgaaatatttatgagctctcaccatggccatgtctaatctgatgagttcatttttgagtttttaatttaaaatactatatacaaactacttttcaaatttactacatcaactttttagtctcctaaaaatatattcctttttttaaattttttgaaagcaaatgtgctttataatctaacagtgatatttctactaatgaacctctgtggatctgtttgtactctttttctgctttcctttcaaatggtggaatatcatttccttgcgtacttagatgcctttgaatgacaaagatttatttttctctgaaaattattattgtgcacttttgcatattagtaagaagaaaatttgccaaagagaatttgaattttttgtgagtctactaaaggcaccaccattctgggaccacattatattaattcttggcctaaaggtgtttggacgtatgtttggacagcacatttaaacaatttttaaattaattgctgtaaatcattaatgattgagtttctttaaatctgtcaaatctcaagtcatttttatttgccatttccagggaatgtgaaatgagactaatttacctctgattcttctttatactgaggagataaattttggtgctagctttagggaagagctcctgtgtgatgccctatcttgggaaacactatgtgtttctttactgtcctatgtgatgtatgaccataggaatctgcactcattcattttgctacatgtccgtagggcaaaatcagtatcagtgtttaggtgtattttgtctgctccctgcattcccatggttttgaccttatcttttacttttttttgtgaacataccaatgcttcaatttttttccagtaatataatcaactatactataagagaaaaatttcgataaaacacaaatttcatgttttcctactctaattggcttttacgtaaaaaatacaggtaaaatttatttgtgcttttttgctatttctgttttgctattttctgtttgtctatgtcttcaccacatagacacaattagggaattttgtacactcttgtgccaactgctttgacagtaacaaaatgtatttctcgaactcctaggtataaaactcaagtatccactatttaaattcttttttgctcacttctagtatgtttccagtctcaatagaaatcgatgccaatccagaaatacaagcattattctaatacttctcacacattactggtatggatgacattttctagatctccttaaatactatcatttttcactacttgtatcttaactgttaagttcaacattttctgtaatattaatatattgtgaaaatttcctttctttcttatttgtcccaggttcaatgttttgcagtctctacctcaccctgtgaagcataaacattgtacatgctgtacaaataatacatcgttcatgtacttagagattgcacaatttttatttggttgacaatagctaatgttttcttcttcattttctatttcctgatttttctttatttagtatatactacactgccataaaaataagaacgttttacaaactaaagcaaaaggaaccctaggaataaaatgcacaaataaaatatataaacatacgtttaggtgtaccacgtacacttgtaatttatttagacttttaattttagtacaattttaattaaagtctgtgtattatctgtcatcgtcttagtattttttatataacaaattgtgtaaatcaaaaagtatcaatgtcattgtaaactatcttggcagaggttgatctccaaggaataatttctctcctaaattatgccaatccaaatttcactctaccgtcattcttttcatcagtttcagaggaataataaatttcaaaattgttcaaggtacttcttttagttcaagtaacatttgacaggtgtaaaactgtagacagactgatacaaacgtattctaattgactcaaaattatatgggacctattttaaaatctagattttaaaatgtcgtgtcaacatacacatgttctccttgtgaaataattgttttttattctctggatagaataatttaatctttaaaccttccattcactcttagaaccaatatattacataaggatatgcttataaaaataattcccaactagcttttcagttcagaaatatatgtgaagaatcatcaaacatctaatggatttcaaggagaaatgggttagtaatttattccatatgtctcaatttttcctagactcaaggcttcctttaaaataattgtaggcatttaagaaaccatgcaaactaaaaagaagaaactgtgacgctgccgcttaggctttttaagtctttggacatgattcaatatattttttaaattgtatcttaattagacattgtgagttcaccatcttcctgtcaatacagcatccaagctgattatcatagattacaagttcaactatcaactgtgttctgagagtctaaaaaaataaatgaacgtatttgtttgggtattcttaaagcaggagtgaggacacagcgaaagtgagacaaggaaaagagaacaaaataaaacaggaaagacagaaaagccaataccacacgtgttaagaggtaagttcctgtgttagatatctgggcttaattttatgggaagctatgtggagcatgcctcagaattacatcactgaatccagggagattcttcttagttaccctcaccttttcttcccacttcatgcccagtaacaagctcccgtgctgctagagaaagtcctcagctagaaactggtgcaaattctggagatgagaccttgtagagtgttaagaatggttttcttcccagcagctacagctaaggaataggggctgggctatgaatacatctgctacaaaccaataaagcccttatgctccttttggtgatcgacaatgtatttaaaaatattagatgatcaagaagggctgcagaaaggaggaaacagaaacaaacagcacacctcttggtttattttttttcatttcatcagtttcaaggaaaatatgttgggagttcctggcatagagaatgtcacaaagacatgttttcaatagtagtgctatcccgagggcagagaagacccagagaaagcccaagtggctgctggaacaaaatcagacaccgtgccacctgtccacactccttggctctgccatcatgctgaagatcgctttaaaggactggcttccctccccccaaaattaaaagagcacagactgagaaactgaatgtgggagacagcagtggattatgctgttctcaggggtcacctcaggtttggaagcattctttcaaattaacccatctcaggccatctgcagagaagaaaggtggtacctaactttttttcttgtcggcatttggtaggggtgttttattgaccaaatatgttcccacaacctcgttttttgtgactaactaaatatagtagagttttaaattttatcatcaaaatctatagacaatttttgatgaaaatagactccatctctatgtcctgcttttcttcttcttattaattacattgctgtataaaagaacaagacttcagcatcaagaatatcttgtctcttggcattgaatttatacaaggtgctctttctttaatgctgtctcaaaggacatatttttactcattaaaaaggaagatcggaatctagttgtatgcactgctccaacatattaataattaaaattaggaggtaaatgtggtcaaagctatagaaagactgagatgtcatttacatcgattactctatagcactctacaaacagaaattgttaaataatagtttatataaatattttgtagcatttcaaatatttgagtgcttgaagtttctcctcttttatagttcagattatcaatttgaagacttactccgctagttaatatgtttttagtctcgtctgagtattatataaaagcaattttcagttaaatgtgttccgcttacataaaacgttacaaattattgaggatttaattacttattcatgttcctgtaatgtctttagaagattttcttattattacctatcaatatatgtatgctttgtcaaagaaaaatcaaacatatatatcaatgaaattgaaactttttaaaagtacttattaattctattgaaaaaccacatccataggaacaattacaatataatattgtgaacatgtaaacatataccctatgtctattttatgtataagcatgtatgattaaaaatatagtgaagaatttttaaacctagtattataaagtaaaaattagttaacttccgatgattatttgttaattaagataaaattattttgatttgggtgattttaaataaagaaaaatattaaattacatgacaaaaattctttataaaatgtttatgatttttacattggttttatcacttttcccactattttattttaagatgacctgccttgcttaaaacactgtattcatcttagttaaattagattccatttgtaaaataattaacaaatgatttgctctattgtacagtgcgtttataaactgagtcagtatctcaagatttgatccccattatcatcatctgtggccctatttgttttataaatgtattgtctttttccatgcctgtcacatctctattgctctttcatttttctctttgtcccttatagggagcattgcctatctctagattaagcaaaagttgcatcataaaaaagcacaataacctgctcaatctttctcacacagagaaatgtttgttaagtaattaaagtgtagatgatgatacaaagagcttgattaaattagatgccaaagtacccttgtgattcagaatatgaatggtatttaatttctttgaaatcattaattgctgagtgagattaattaatgccaatattccagaagatgttccagtcagtaaactgtatacaacgtgcaaaagattcagaactctgaagggcaacattattctataattaagaattaagaattaattcacattaattactggggagaaatactttttaagaattaatgactgagaaaatgtttttattttttatttagaaaattattttgtgcatgagcattaccgcaagttttgcaagaaacataaatttaaagaaacaattatgtgcacaagatgaatttaataacatcttgatatattccacgattgcggttttatttggtaaatctttcaaggcacaccatttaaagagaataaatgagtcttggaaatcttgtaggtaagggtaaatattaggatgcatccagttacatttacacacacatacagttacatttacacacacatacacgcatacagactgagtcacgtgtgtgtatatatatatatgaatttaccaattgatgttaactaatatttataagagacagttggattgatatatattgttgaacctgaaaaatatttattatatacatgtttaaaatacagaaataaatagcaattgcactaggcatttgaaactgtactaaaatataagctgtgaacattttgtgatcattacaaattcttacactgaataaatatttttatttttacaatattaatatgtttgatacctgtgtatatttttttacaatgtgttattttatttttgtcatagagtcatgtcatgcataataacattttagtcaaagatggattacatatacaaaagtggtcccatgagattataatagatatttttacatacttttctacgtttaattatgtttagatacataacctcttaccactgtgttcttattgcctgcagtattcagtacagtaatgtagtacacagatttgtagcctgggagaaagaggctataccatataaactaaacgtggtaggctgtacaatctaggtgtttgtaatactctctgtgatgtttgcaaaatggtaaaattgcctatgaatacatctgttaaaacgtatccctatcattcagtgatgtgtgactgtactaaaatgctcaatgtaagtttcaatgacctccataaaattgttgtactgtgaaatacaaatctctcacccatggcctgaatatgtttgcaaactaagcagatcatgggaaggagaatgtgctggcaccgctgggatgattttctcactctacatgaataatatctacagacttcgtgaatatgagccacttgcatagagttaaagtaggcatctctttgctgggaaaattatcaaatgggagtatgaagtgtttttacaagatactcatttgtttgtagctggtaggcctacagtggctcatggtaatggttgaggttgctaagatttggtggaagaaggcaaaatgaaatggccacttatatggtatatggtatatggatcacttatttctgttgagttacaaactcagctggctatttctcctatgttagttatttggagaaaaaaaaacgtgatggtaattttggggtaacaaatacaatatttgatgaaagcaaatttattgagggttagacaaactacaagatactttaggctacaaagtcaacacgagagttctggcccaaattgtgcagagtttgcgtccagctgcacagttcaaaggaagaggccatgtaagaagattctcacttctgacaccaactgccagttcaggggtttcccctgaacaccctcagtttcaagaatttactagaaagactcacagaactcattgaatgccattgtactcatggtttataatagagaaagggtagaaattaggaccaatagaagagacatatcatataaggtggaatctaggagattttgaaggttaagtttccattgtcttcaggacatattacctgtcattgttgtacagcaacaaacatggagtactaccaacctggggagctcacctgatgctaacaagacactatttacaaaatgaaaagacaaaggaaaagatgagataagatgacgttccacattaaggcactggaacgaatagcaaactaaacctaaagcaagcagaaggaagaaaattaaaattagagaaattaatattttataataataatatttgttagtgttgaataattgatattaattcttgactagcttttttaaaaaagagaaatattcactttccaatttattctgtggggccagtgttactttgatacaaaaattagtccaaatagcatagaaaaataaaactactataagtataaatgcaaaattccttaaaaaatactaacaaatcagatctagcaacatataaaagaattatacactatgacaaagtgaaatttatacaagtaatcccaggttggtttaacagcccaaaatccattaaggtgatacatcttatccatagaataagaaaagagaattcatgatcatctcgatagattcggaaaacacatttaacagaatccaaatgctttaatgattaaaaataaaaataaaaactcaatgaaccaggaatagagaactttctacaccagatacatggcacctgtgaaaagccaacagcaagcaggcaacttaatggtaaagaatgctttcccgctatggtcagagataagaataggatatatactttgacttcttctagtcaacactgtactaaagattttatgcagggcaaatcggcaactaaaataataagagtcatccatattgaacaggaagaaataaaactttatttgaaaataacattgttgtatatagaaaattttaaggaatccaccgaacgatagaactcgtaaattatttcagcaatattacagcagacaaggtaaatgtacaaaaatcaattgcacacatctgcaatgaaaaccccaaaatgaatttaagaaaacacttcaatttaaaatagcataaaaaaaagaaatattaattaatttggaaaatgtgatacaagattttactctcaaaattaaaaattattgtttaaagaatatttaaataattagtaaacaccttacacccatgaattggacgatttgatattgtagtactttacaatttgaactacagatttgatgaaatccctgcaagtatcccaacagacttgtgtctagaaactgacaagctgattctaaaatacacatgaaattgtaagggactcaaaatagccaaaataatcttgaagaaagaaaacatattaggataattcacaccccatgctccaaaccttactgcaaagtatcagtaatcaagacaacacaacattgatgaaggaaaaatatatagattgatggaagagaattgagagtccatatataaaactatgtgtctacagtcaatggattcttaaagtggtgccatgtgcaattcaatgaggaagagacagtctttgaacacactgggtcaacaacgtacacgtggatcaccacttgcaaaataataaattagaacccttaccccaaagcatacaaaaatattaactcaaatgaattaaagacacacatgcaagaggtagaataaagcatatgggaaaatcttcaggattttggatctagcaaagaaatagctgtaaccccaaaaacatgagcaacagaataaaaattagatatttaaaatttcttaaaaattaaagacatcggtgtttcagaggacaaccaagcaagtcaaaaggcagctccaaaattgtgagaagatatttgaaaaacacgtatctatatgtctgtatatatatatgtatcttgaatatagaaaaattggtttaactccgtcacaaatatcccaactcaaaactgataaatgataggaatagatgtgtttcccaagaagatacatgaacggtcaataatcccataaaaatatactcaacagcatcactcttcaggcaactacaaatcaaaaccacagttagatactctatggctagaactgaccactttggaaaataatttgatggcttctaaatatatgaaacatagaattgtcatatgacccagaaatttattcctaggtatacacccagattattggaaagaggtgttcaaacacaaattgtacacaagtatttttagcagcagtacctaaaatagccaaaggctgaacacaactcaaatgtcaataaaaatattattggataaacaaaatgttatatccatgaaattgaatgttatacagttataaaaagaaataaagtaccaatacgtacatgaaccttgatagcattatgccaactgaacgaagccgggcagaaaaggccacctattgtacgattctatttagatgaaaacagaataggaaaatctatagagacagaaaacagatttgtggttgcttaggattgagtaggggatgggtgcataggaggttaacagctagggaaggtggggtttctttttgaagtgatgaaaatgctctaaaattcattgtgatggtggctccacttatctgtgcatatactaaaagccactgacttgtagacattaatgtgtgcactctacactatgtaaattatatctcaataaatcctttcaaaaatacacagaagagtaaggggttttggaatgttgcaactgggatgcagtttgaaatactgaataggcctcatcgagaatgtgaagtttcagtaaagacctgaggaagttgaatgagctgatcaatggatatatggagggctatctttccaagccaaaaaattaactagagtcttgatcgtaaggcagcagcatgttggtatgtccagaggacagtgaggtggccaggaccactggtaagatcaagggtgaagatataaaataattttggcggttaacatgcggcagatgatgatgggcttgcagaccattgtaagaaatgttgtttttaatgtacatgaaatggggagacaactcattatcccattatcaatattttaataaattggatccatgaaccaaatccaatgagattaaatcaattaataataatatgcaaatttgtattaaaattacaagaattacttgcacatttgagaacaggagagacatgatttttatcagcaataataaacattattaattttaattgtgatcagctaattgagattaattgcaatacatcttgatttataatgtgactgtcaaaaggaaaatatgattgtaatcttatactacatctatcaatgtcttttattcataagagtatagagtaagcccctagttttcaaagccaacctatgaagcagtgacatcttatgcaagtttgctgctttctgccacagtgatccttggtcagtgggcacaaattgtttacaaaggcccctaggtctagaaatagtttggatcacaatgaacacagaaacaccttcatcccttcagaaatacccatcaattacttccaatacagaatgaaaaactgacaaaggaaatatgtggattgtaaaaatgccagttagcttgcaactacatgaaagaaaaatgccatttttattacattaggtcattgtctcacatgagttttggtatagcaaaatgttgaaccaagggaaaagagagatgaattaatgaagtcttaagatatcaagaatttgaaagaaaaggaaggtcatctttgaaggttagtgacatagcattcatcttcttttgtcacctttcccgtcattccctgtatgcctgacggacaggttacactcaagttcagagaacagcatgcaaaattagctaccaattaatctttaggaagtgagctgcatttctagccagactgagcttacgttttagcaggaagcatttttgggaaatgtttatgttagactttgcccttcttgacaaggtgagacataaacgtctactttatagacatgaattgagatgggaagatatttgggggaatcatttactcaaacgctaaataataaaggtacacaaagggcaaattatactagatttctttcccacttgttttctatgtctcatgcaattcaccttgattcccttcagtttctgtttaatgtagaaagtggcattttcattattttaagcttctagcacaatgaaagaatttctctttttcatgaacaggatcatacacgaaaaggaggaagagtgtcctatatcatatttattgttcaacaaaacactgctccacggcttaaattcagtttaaaaaagagaatttgttgaacatctaacacatacataaaaggcagtaaagacacatgagaagagggcaggatattgaagtatacagacttcaatgctgagttttatatcttaggaagttactccacctgacagaagctcaatttcccctgatttaggaaggcgatgctaatgggtattgcataggtgtaagtataaaaatgttgtatttaagagaatcccacaagcttggtataaggcagaaaataaatagatgtgacatgaataagtagtttattacatttgtatgctacctgcggactagaggaagcaagaaacacagccactatgcttgattagcattatagagatggtacgatgatggttgccagaagctggggggaggaggaaatggggaagtattgtttaatgggtatagagtttcagttttacaagatgaaacgaattatggagatggatggtagggacggctgcacaatgttatgactatatttagtaccactgaactgtacacttaaaatggttaacagagtacattttatgttatgtgtattttaccacaataaaaaaataaaataccttaggaacattttcatgaaaaagcccacataaaattcattttaatgcacgtgtttatgcatagctttctatttttctcttttctctttatattccaaattctaatcagagaagggaatcccctctgtacctccaggatattcagtaaagaccactggaggttcatgccctagtgacagtgctcatttagctccaaattacagatggctctagattaactcaacaaagtttaaagagaagatttaaaacaagacaaatactcatcctgaagttactgaactgcctgtcacaacattattcaaaggtagccaataaaatctagatattcaatagcataacatcaaaatacccaaaaaaaactctgaaatgcaaagaagctgtaagacatatataattaaaatatatattaacaggataaaaataagtcatttataaatgacagacaagaaggaaatttcaagatccttaaagtaaatatattttataaatacatatagataaatacatatatatgtcaaggtacttaaatgaaaattaaatataggagaaaaataaaagttataaaatgaaaaatgtgacatatatagatgaaaaataaatacttgaaataaaaattccatgagatagaataagtaatggattttaccctaacatcagaacatttatagaacaaattagaagcattacaaactaaaggacaaacggtaaactaaaataagaaaaccagaaactcactcataggtcagacaatgtgcatcagtgtaacatacatgtaatcaatatctcaaaaaggatgggtggggtaatcataggtgaataaggaatggtacactcattcctgagggcaccgaggagggaggatagctttagatttctaagggagagttttatccattcatgaaggtccaaccccatgaccaaacacctcccagtgagccccacctgcaacattggggatcaaattttaacatgagattggaaggggcaagcattcaaaccatagcaagagttaaatttcctttttaaaaaattcactgatatgattccatttcgccatagataaaaactagtatttcagcctaccattgagtgtgcttatagctcaccaaaagggcactcagtctcgggaatacagatttgcatagaggtatcctattgcagtcaaagaaagagcaatgagggatagaaaaggttagtgatggagacaccagcgctgcattttgcaacaaacaatgtaaaaactttatggattggttctgttaacttacttcagtttacattcctctcaggtgggagaatcgttgcgttttttcttaagatagaaaagcaattcaggtaatctgaaatctccacaagaaggataagaagcacagcagaaactattctaggcaggaagtcaatcctttcaactgtctgtgctccatagaaaccattgtctgcactgggagtcatatgaggtacagacaacagccagacctctgatcctctcattagtgatttcagaagaaattaccagtcaactgagtaactcactgagtatagtaaacatttggcactgaaagaggttagatgaataactatttgtatcaccatattcatgaagctgaaatatgttccattactggtatcacatccgaatggaagatattaaaaggtctctcatcttgtaagatagatatgaaagaatattttctgagaaatgaaattattaacacacctgcgaggtgcatggaagagaaaaaaaagaataatcaccttgagatcttctccttgataagagaactcactaaaaacataaagagaaaaatacaagtttaaaataattaaccagaagaagatgactctagagattttaaattgctgataagattttaatttgctccaagttgaaaataattatattgcttgtgttttaaggcacataatgagcaattatatcacacatgatagtttcagcagtaaaatagtatccgttaacagctggaactcataaaagcatagcacaatgtgaagatggaatttgctaaaataaaccatctgctgaaaactgctattctgcaaatttaaaaataaagtttaaatgttatttgtcttatttaataggtctgtgaaaaaaatgcgctatttggaaagcagctgctaccttaattaattctttatattagacggctggttacaataatgtacagtaaggtgctacatagatatattgctaaattttctgcatatactatgtatttggcttaaattaattgaaattttattgttaaaataacaaatgtacatttcaatgttttgacacaaattgcaaatatacctttaaaaagcgtcttacactctaaatattatttgtcacctatatatttgtcttttctctataggaaaatttaaatttttcccttgaagctttaattatttgagtctataaaacaaactgataatgtacaaattaacaggaaaaaaaggtttacagatatgtgcacaagtatgcacttggagtttacataatatatataaatatatctatacaaatatttgtatattataaagagatatacaaatatatactctttatataaaaactccaggaaaggcaaggtagtcaacatgcctatgctgtcttgaggttgcagaaaacacagagctgtaggttggtaaatcaggctttgtggaagacaggtgacgacaaggaagaaagaggagcctggcagcagaggtggtcttgttacatggatgaaacctcacagggagcagccctcctcttgggaagtatagataggaaatggcttttagaaatgtaaacgtgccaggctcagttaatcattcctatacccagacaagggagtatctcagggaaagcctgtctatatcaatgcagattttctctacaaatgcaaatctccccaacaaacacagcttttcagctattcttgtagaagaagctatctccagtcttccgagtagccatcgtgaaatatgtcaaaaagctggccaggcgcatgcctgtaataacagcactttgggaggctgaagtgggtagatcacctgaagtcaggagttggagaccagcctgaccaacatggtgaaacgccgtctctactaaatacaaaaaattagccgagtgtggtggtgcatgcctgtaatctcagctacttgggaggccgagctaggagaattacctgaccctgggaggctgaagttgcagtgagccaagattgtgtcattgcactctagcctgggcagtaaaaacaaaactccatctcaaaaaaataatgtattttagggtaatattttgagtatctttacctccatatgtacaataaaaattattgcgatttttaatcttttctgtggagaaaacacaggtgtgatttctagtgtagctgaacatcgtttatttgacagtattgcacttgtgtgtgggtgtgtgcgtgtgtagctactttttaatttggttcttacaaaatgattagatactaacaattaattcagtaaaatgtatgttttgcaatatttctccatgttattatgctttaaattagtttaatcatgcccctataatgtgtacattttaacctttgactatagctctcaatcttactttggttcctgtatttgaatttatgctaataaagtcccacagcttaataagattacataaattttttgtataatttttactagcattctggtgtcattttaaattatgtaatgaaatccaattttaatttggattattgttatctgagttaaggatataaatttttaattttcttataaatattacataattatttctgaaccatacattgactaatctgccctttatatgatgtgtattataagagcttgggatcgtttcatttgcaaagatgaatgcttgagaagtagatatttaatcataacatttcaaaatctactggataacctagaattgaaacatagcctataggttgaaaaactcctgtagtgaagaaagaaaataactaatatacagtgacaatataaatattataagtatttattttattatcaccctgaaatttgataatacaaacatgtaatatctacatatcatccatatatcaggtcataaaatatcaatacattcttcaaaaatttagcataacagaaaatgcactctctctccttgatggaattaagttacaaataaaagtaaaaataagtagataagtagatggaagtagatgtttaaaaacaaagaaaaatatttgttttggataacataaaatctcaattgacaattccaatatttccagaactttgcctgtcaactggtggagagttttccccaggagacatttgtcaatgtctagggttatcgtggggatgtcaagactggtggaggtgtgaaatttagaggtcacaagaaacacctagcattgctagggcagcctcccacaacaaagaatcctctggtcctaaaggtaagtagcaccaaggttgagaaaccataatctagacaggaaacactacgtagctattccaagtgctcaggaaaacacatcagtgccctcgaggggaaaagtgtaaacattttaattgctgtacatggtgacacaaatccatgttgttaatctaagtggaaggggctgaagcacaaaacgtaattcaaagagtttacttaagccacagtgaggacagctgcctggaagaaacagacccaagtatccttggatgtgaactccctttggagctttgcaacaagcagtttcttaaaggtaaaaaagggtccagaagtgggatgatgcaaagaggtttgtcacaaattctcattggcttatggaaataacatttattagtgactggctatacacggttacactattatggggtgtggattatagtgtctggtgtggcgttattggttaattcatagctactgtggcaacagcaagcagcctagatgaacacacagctcaaagaggagcaggacagaactgctgtgtcatttgaatatctctctgggcctgattatttcaaaggacttgcatttctcacatgaaagttattttcttttctccatgtccataaatgagaataaatagacgtaaaatagatcttttcgaggatgaagtaattggaatgaaaaacaaaacccaagctgaccggaaatcattgagggaaaaaaaggatataaatatatgtatttttcaaagtgattttaagctattaggaatcagttaaatgttgggggaatttgtctgataatgggctaaaggagaatgtcccttttgccttctgaagtctccctgaaaatcactaataggaggcagataaatagtagaaaaggcatacaggtttctgcaatgtgtgtacactggaacccttagaacgaagacccagtcacacgatgcgtgcagaagcttatctaccacatgaagtttacagaaaaatggggtcttggatcacagggaaaagaaagaaaaaggttatgtgagaaaacgaccctggctagcaacagtggacttattacataggtggaatctcactgggagtagtcctcagagagaatagacagaaaatgtttctttcagacatttggagacctcagcctctcagttaacctttcctagatccagacaagggggcagacctcagagaaaacctggctgcatcagggcagattctctaccgatgcaaatctccccaagacagctttgcagctaacattgcatttccagcccttctcaatagccattttgaaatatatcaaggaaatatatttaggggtaaaatatgttagtttccttcatacagctataaaacatacaggaataatttttgtcaatgtctactacaaatccaatatagcagtaactatgacacccaccagatattgatgaaaaaatatgtagagtacctcaattacaaatgttgatactaaaatgccaaataaaatacaaataatatccaacaatatttgaaacaattagacaagaaattggcaaaaaaaaaaaaaaatccaccttcgggatgaaagtgtgtttccaaatttggtaatccagtaatattaataatcatattgattagcccaaattaaaaataaataggggattctcagtacatgctataatatatttgttaaaaggcaatattcatgtctttaaagattttaaatgctataaagagtctgatattctatatgcaaacatgtgtatgtccattagaagaagagaggcctgattttcatatgttactacatagagatagagaagtggatacattaatttgcatatgcatagagaaagcataacatagaaattgactatcatattaaaggaattttaattcaacaataaaataattcaaaggtaaaattttagatatttttaacaggtacattattagtattagataatatttataataattgtgaaaatactcagcgctaaaataagatacaatgtctaaacatcagtaataatactagtataaatatttgcttgtttatacaaggaaaattcaagctcgacctaaaattataagggaaataaaagaaaaatattaagggagctctttcacgacataaacgtatatatataaacacacacatataacatgtatatatgttatatgggatagatatagatttagcaggttatatctatatttgtatctgtaactacagctgtatgtatccacatttctacatatttactcagtgatataaatatagactggaataaatataaagacatatatgattcttggataaaaaggatttagtatcataaagacaaattctttccaaattcacttatgaattcacaacaatatacagtttcattagtataatttaatatttctaaataaatttcaagattcatttaaaggaatataaatgtatacaagcagtcaagaaagaagcaagagggcactaaactaacttgctgttaaaatacatttttaaacttagtcactaaaaccgagcagtactgatttggagtactggaatttaggtgtatgggatctcaaaagcacagagctcaaaggagacccctgtatgcacgagagcttaggatgtgctttagaaggcattaccaaaccacgggcaaagttaccttagtgtcttagtcttactaggtttgaaaagccagagaaaagactcaagaccaccatataagagcaaaacaaaaggacagggagagaatgtgaagatactgaaacattttacataaagttgtataaaacatattttaaagaaaatataaagttttggatatacatcaaaatcagcagagccactaaataaataaataggcattgtaaaataacaagagaaaatttaaacggatttctaaaaacattgacacctatgatttttaaaatatgtttaagaaatcccatatttcacagggcagcctttcacaacacagatatgttaggacataaaggtccttctgtttttaatttactagtgtttatagggttacaaatgtcttctacccttgtcttttgtctgatggtgcaaaaatttttcataagcatgtatttctgaatgcctgatggattgacatatataatatgttgctagtattaaaatatgagatggaaaacgcatccaatcttctcactgtttacagaaattctaggtttctcctatttacctcaagcacatatggagcgaattcttaccttttaatattgccatggcattcacattgaacataagttgaactctctcatatggtagctgggttcggattctcttgacaatttccagttctaaccctcacacttcctcagtgtggttggcccagatattgaccctacacagttatctcctcgtggtgactaccagctatggaaccgttggatacaacctacctgactcaccccacagacctcacagcgcacatggacagcccccacacgccacagtaacctgctcgcttgcagtgggagtcaagaaatgtgcctgctggcactcaccccaccgactagtgccccgtggaaaacttatttgggtaatgttctgggccaaataatggctggagtcccacagaccccttttctctctcctgctccccactcatcttccccattttgtttagccctatgaggtgtgctactgtattagtccattttcacaccgccggtaaagacatgcccaagactgggtaatttccagaagaaagaggtttaatagacgaacagttccacatggctgggtaggcctcacaatcatggtgcaagctgaaaggcacgtctcacatggcagcagacaagacaagagagcttgtgcagggaaactcccctttataaaaccatcagatcttgtgagacttattcactatcagaagaacagcatgggaaagacctgcccccatgattcaattacctcccacctgttccctcccacaacatgtgggaattcaagatgagatttggctggggacacagctaaaccctcttctcagctaccctcttctctctggatctgtgagtaataaacctacttctgtgatttcccatgtttggttctgtggcctccatgtgtctgagctgacctacactagaacctaactctcctcctggccagggtctctgagagtggctcttgtcagaaatacacaggacacaggtcaggcaacagtcaccaggcatctcctagtctcaacagatgttctgtgagagggaggcctggtcgtgggatgcacacctggccaccgctggggtaaggaagtgtcctgtgaaaggcacatgttaagcatccacaaccccctgaccagaaccccagaaaggcagggatccaattgacagtcactctccagagacaaacctgaagccctaactggaggaaaagacaacaatgtaaaaagttgaatttatcttactatttcaatgatccagtaaagacattctatgcctgtacaccacatattttcttcgattgtggatttattttagatagaattttaggtctggctttcactttagcctggtccctacctcaagcataaggtaaagattttccatgggttcttttctggtactactacctgccagtgtggggtcatgtcctagtctatcttgagggaatccccctgttcattattgtcagagtgagactgttaagtcttgatttccctgtacaacttcactgcgtgacttttaatatgattttttaatataccctttactggacaataaattctatagttatctgagtaagagatatgctcaggaagaggcattgcctcattcagcttttctctttggtgaactcgcatatgttctcctcacccgccagtcacccctaaaccgtattgttccaagacaacaaacagaactcgagtgtttatctttcaccactggatttgtgtttgctccataaagcttcatgcttaacagagtttctgttagcattttctctatttattttcccataaaatatcacaggccttcttcttatggaattatgggtgatttccttcaatctgcatcatatcaagttgaggttcatgttgatgaaaagtaaaacatacgttgaaaatatcagtaaggatgttttcccctcctttttagcacctgtgcttgtgatacaagcacattttaatacaattgtagtctcatgctttgatcattcctatgatgaaaataacatttttagataaaatatctgagttttatgagggctttagtatgtgatgtgatagaatatcagaagaccatacttttttctagttgtccgtgcaattctatcattgtttcatctttactcctaccagagtaattttccaaaatagatatcttgtcattcttcctgttgttatcagtaaataagtgaaatgaaaagctagattatataatttatctagaacaagaaagtagaattgaatctatattcattaatgagactaactagtcaattacacagacaggcattttacattttgaagatcatatggacccattgtcagaaatattattatttatgtctatatggacatcacctgtgcatatttacatagaaatcaatgatagttgatgtttatttttattatatatattttttgagatggggtcttgctttgttgcctaggctggagtgtagtggtgcaatcactgctcactgcagcttcagcctcccaagctcaagcaatccttccaccttggcctcccaaatggctaggacaacaggtgcacatcaccttgcccacttttttttttttaacttttgatagagactgggtcttgctatgttgctcaggttgcttgtgaactccagggctcaaggaatcctctcatgtcaggctcttcaactgctggtattacaagcatgaaccaccatatgggctggaagctgatttttaaaatactgagatcatatagatgacagcatctgaaaaatagacaacaccaagttttacgttaaaaggtgtgagggtagcaatatggttgtggctattggggaggaaaccattagtaaaaccagtaagttaaagctcttgctttaaactttggctataatttaacaaatgttctatggagtgacagtatgtatgtaaccatgctatacccattcacagatgcagtagagggaagaatttctcaaagacaactgttctaagactcaaattaaaccgtcctgggtttgaaaagagaaagtccaggaattaccaaatattttagatatcagatacaagagaatgccaggtatgcgatgataatcagcaatggttgttcacacaatacatcaaatcagtatttgaattagcttctgaattacaaggacaaatggatcaagtctagactctttagtagagaaatcttatcaggctgagatgtgttttcccctgtttttccacaaggagattactaatttggaaacctcagctgctcttattttatgctctcaccaagccaaaagctgaagttcatcaatcagtgtgtctaagtgttcactggttatataccattttgtagtttcagctatctttccaacttcctaaatcatcaccttcatttgatcttgtttttttccactatcacttctttattgaccatataaagaatataagtaagttcttattttgttattgttcattttagtctaatttcatcaaaagatcacaatcttttaatttcattttaatttcaaagattaaatgaaacctacatagaaatgagtgtaagatttgcatttgcattattttggcatcaatttgctatcctccctcatgcacatagagatcatttccatgtatgtgatttcaaacatccaagggcagtattaaaagcagttgtaaattatggttctcattttcgtgatacaattacaatataaacttcctcttgctgctgtaaccaattaccacaaacttcatatattacaataaagtgaccgttaatcccacagttctgtagtacagaagccttaaatgaaactcgcagggctaacatcaagttttgggtagggctgcagtctttctgagggctatgtggcataatctattacttgatatttttcagcatccagaggccacctttattctttggaacatgacctcattcttatatcctatttttcttttttttttttcagatggagtctccttctgtcaccaaggctgtagtgcagtggcacgatctcagctcactgcaacctctgcctcccgggttcaagtgattcttctgactcagcttcctgagtagcttggactacagacacttgccaccacacccagttaattttttgtatttttagtagggatggggtttcaccatgttagccaggatggtctcgatctcctgacctcgtgataaacccaccctagcctcccaaagtgctgggattaggcgtgagccaccccactgggtcctcattcttgtatcttaaaagtcagtgatgttgagtaatttctcatgccaccacctccaaggttgcctttcttctgccttcttctttcacttaaaaggaagtttgtgatttcattgatcccacccatttaagacaatctctctatcatttttctgcaaccttaatttcacttgaaatctaatttcacactgccgtgcaacctaacatatttgtatgttagactctgggaattaggacatgaaaatttttgggaggccattctttggcctacagcagacataatctatttacctgcagattaaagctttctatatgtttctgactccctctcttaattttctaaaataatattaattgcagtaaagagaaagaaagaaaagaaaacaaagaaagaaaaagatggaaggaaagaaggaaggaaggaataaagaaagaaagagaaaagaaggaggaaatgagggaaggatgggagggagggaggaagggagaaaggcaggaagggagaaaacagaaaacatgaacacaagaaagaaagaaagaaagaaagaaagaaagaaagaaagaaagaaagaaagaaaggaagggaggaaggaaaggaggaagagagaatggtaaaagggaggaaggcaaagaaacaaagaaaataaacaggcgaaggaaggaaagaaaaagaggaaaggaagggagggaggaaggaagaaaaaaggaaagaaagcaagaacgtgagaaagaaagaaagaatatgagaaaagaaggaagaaaagggagggagaaaggaagggagggattagggaaggaagaataagaggaaagaaacaaagaaggaaagaaggaaggaaggagaaaaaaagaaggaaaagaaagaaaggaaaagaaaaaagaaaaggaagaggaaaagaagaaaggaaggaagaaggcaagtgaagggaagagaagagaaaggaagatggaaagaagtaaggaagaacgcaaatgttataaattctgggtttgttagagaatatgccatattgtttttttttcactagaaaggaaagattatctgccattgaagattggatgtcttgttggtgatattgttgttcttaacttccacatgattattgagtttgtgccttgtctttccattactaagacaaaagtgttgaagtctgcaaatataattttgattttttctagttcacctttgatttctttcttgttttacctcatgtatttggaggttctgttgttagctgcataccctaattagtaggatgtttacatcttcttgtatgtaattgatgattctattatgtattatctctcatctctgatactatttcttgttccgaactctgttgtggctaatatcgatgtagtccttccacagccttattttagtgtttccatgatatggctttctccatatcttgatgataacctatttatatctctatatatttggagcaagatataaaatttagacctgactttttaaagatttttcaagatgtaattcttatttctttttgttctatttgacattctctgagtttcctatatttgaagtttgattttctgtcacttcttttacaatatttttggcagttattttgaaaaatatttcttttgctccattatttttccctcttttctttttgggatttcaatcataactagagtaggtaatttgatctcagtcttatgcaggtactttttctcagggtctcaggaatgtaaccttctcacacttctgttcttttcctggctgtgttggtgagctcagtgatattcctccttcaccttctagagcaggtttgttttgtttttcttgttttcatactcccagcatcaggagtattctaagtgtggcagtttttgttgccttcccctacatattaagtggaatatcttgctctatttggactcttataacaaaataacataaactgagtgactaaaaagcaacagatttttttttcacacttcttgaggctgtaagatctcaggtcaagatgctcacaaattcagtgttgatgagagcccatttcatggttcatagatagtgccttctttctatgtcctcacgtagtggaaggcacacaagaactccattgagcttcttttataaagacactaatcccattcatatgggctcgacccccaagacctggtcacctccgaagtgttctgctctccctgatctgtgtcatatacagactctcttgaattccttaccaattgcttgagagatcgcattgagtttgtggggaaaatgttttcaagatggtggatctttcccaacttctgcagctgtcagcggtctcccaatctcaccagccccactttgtctttaggaatttattgattattccagctttacttgtcatagtggtgtctatacgcatctgtcctatgtaagtgcgtctgtcctttttctccttgcaggtgcaagtactcaggagtacactgttgttactaattactcagtattggttggtacattgtcaaagaccaaagaacatttttaaagataaaaaaaagtcttggaggttgtgtaatgaagggttaattctgcagacatggctttccaaaatcttgtgcattccaaaggtcttcaggactggcccttgacaagctcctgggagatgttaacctatgagcccttggtatatgttgcctgatgtgagtctttgcatacatgaaaacgtaggtcatatcaaatagctgatgctaacaacgtgatttcttgtgagcacctgtttctgtatgcctatgactttgtgtaatgccatattaatatgacctctcttaacgcatagggaggttgggaactgagtagctatgttcagtcacaggacgctcgatgcatatgtggcggaatcctaataaaaaccctggactcaagactgactgagcttccctagttggtaataagttcacacatgtctcacaccattgtaaagaaaattagtcagtgtgaagtccccactatgaaaggacacctgtaagctcacatctggtttgtcctggactcaactttatgtgcttttatgcttctgattattttaatctggtttctttcactgttagaaactataaccacaaaaaaaaatcagctttcttgggttatgtgaatcattaagccaaagggggacttggggacccccaataaaatgtatatatattcttaaaaagaaaaagtaaactggctatagcagatattgctgatgacttgtcttctatgtcctggactcaatgtgttcatctgaaattcacctgattccagctaactgagagctccccacatcatgcctgtctttctgatttttgggcctgcctgcaagcttcttgaggctaaccagtgcttctcaaccacacgtaggaacaaagaaggagttaggggtggagagttaatgattctaaggcaatccttaagcaataagagatggggattccagcatccccatctctttgtaaagttattttgacacaatctccatacctccatcattactgagcacacagtagtaactactcattgacactggcttcgtgttctgtttcattttctccacttctgtgctttctcactcaatttctgattaaagtatctgaccccagatatttgtttcatagtctatttttgagggaatccagagccaagacaataacaatgggagctttgcaatgagggagggtgagtataatcatcagaaggttacctacctcactgggaacatggaggcctggagagcttgctgtttcaatgagagaaacatgttgaatctcagttcaatacatatatatatatgtgcaataagacgtgccctttatttatatcaaaggaaagtgctctttacctctctttgttgttgtgtttttatcactattgcctacacaagcagaatatcatacccaggatttaaagccctctctgcaggattttcaagctcatgtttttatcataagtcactctgcttccatgtgttttcaatctaatcctcattcctctgcttttacaccagagaattcatcactgacttatttttgactgacctccttatagagctgtcaagtacacaatttctgctgtgacctttctcttagagttcagtcatatagcctctcactagatatcatttcctcttatctttcctaataatgaattgtcagttaaaactcaacatttttaagattgagcttaccatctgcacacacacacacacaccattattggtgtattctcatagccttgaaacactaatgtcaccttgatgtctgccttttctctctctgctacctcattcctcatccttagattgttctaaaagattcaattagatcaaattggctaattatatttttaagatcctctctacccttcccaacatttcgtttaacaaaatttaaaaatttctggcaggagactgttgaaatccccatggatgactatggttttactattttacctttcagttttaataggttttatattaagtattttgaagtaatgctattgtgtgcatacatatttcttatttacatgacttcttggtgtattttcccctttttcattttgaaatgttattcttcatccccagtgatatttcctgttctgatgtctactttcctcatcacagttttagggagttttggtttgtttgtttttctattgtttggttcaagtaagtttcttataaatctcttcgattccattcaatgattccatttgtttccattcgaagattccactcgattccattcgatgatgattccattcgagtccattcaatgattccattcgagtccattcgatgacgattccattagagtccattcgatgattcaattcgattccatttgattccatttgatgatgattccattagagtccattcgatgattccattcgagtccatttgatgattccatccgattccattcaatgatgacacaattcaagtcccttcattgattccattcaattccattgtatgatgactgcattcggttccatacgatgatgattccaacggattccattcaatttctccattcgattccattccttgctgattccattcaattccattagatgataactccactagattcctttcaatgttgatttcattagattctattcgatgatgatccaatttgattctgttcaatgatgattctatttgattccgttcaataatttcattcaattccattcgaagattccattcgtttccattcgatggtgattccattcctgtccaatcgtttattccattcgattccattcgatgatgattacatgtgagtccattcgatgattccatttgattccatgcgatgatgattccattgagtccattcgatgatttcatttgattccattagatgaggactgcaatcggttccattcgatgatgattctaacggactccatttgaagactccattcgattccattcattgatgattctatttgattccatttgatgatgattcctttcgattctattcgatgattattccattcgattccattcgatgatgatttcattcgagtccattcggtgattccatttgattccattcaatgatgattccattcaagtccattcgaggattgtattcgaatccatctgatgattgcttttgattatattcgacgatgattccactcgagtctattcgatgattccattcgattccattcgatgatgattccattcgagtccatttgatgattccatttgattctattctccgatgattacattcgagtacattcgatgattccacttgattccatacaatgatgatttcgttcaattccattcgatgattccattctattccattcaatgatgattccattcaggtcaattagatgattccattcgattccattcgatgattattccattcgagtccattcgatgatcccatttgattccattttatgatgattccatttgggtacaatagatgattccattcgatgatgtttctattgcagtccactagatgattccattcgattccatttgattatgattccattcgagtccattcagtgattccattcgattccatttgatgatgattccatttgattccattcgatgatgatttcactcgagtccatttgatgattccatttgattccgttagatgatgattccattcaattccattcaatgattctattctaatccatttgatgattgcttttgattatattcgatgatgattccactcgagcccattcgatgattccattcgatgatgattccattcgagtccatttgatgattccatttgattccattctccgatgattaagttcgagtccattcgatgattccacttgattccatacaatgatgattccgttcaattccattcaatgattccattctattccattcaatgataattccattcgagtacattagatgattccattcgattccattcgatgatgattctattcttccccattagatgattccacacgattccattcgatgatgattctatttgagtccattcgatgattccattcgattccatttgatgatgaccccattccattccattcattggtgattccattcaattccattcattgattccattacattccattcaacaatgattccattcgattccattcgatgattacacttgattccacttgacgatgactccacttgattccattcgatgattccatttgattctatttgatgataattccattcgattccattcgatgaggattgcattcaattacattcaaagattccattcgattccatttgatgatgattccattcgattccatttgatgattccatttgattccatttgaggattccactctattccattcgatgatcattccattcgagtccattcaatgattccattccagtccatttgatgattccatttgattccattcgatgatgattccatttcattccattcaatgattccattcgattccattcgatgattccatatgagtcctttcgattattccagtcgagtccattcgatgatcccatttgataccattcgatgataattccattggagtccatttgatgatgattccattcgattcaattgcataattccgttcgattccattcgatgattccctcagaatcctttcgatgatgattccattcgattccattcgatgatgattccatttaattccattcgatgttgattccattcgattccattcgatgatgattcctttcgattccattcaatgatgattccattctattccattcgatgattccactcaattgcattcgatgatgattccatttgtgtccattcgatgacacaatatataattaattaattaatatatataaaatatgtccctagataaatcataacagttgaagaacagaggcatggtaaatttttttgctgttgttttgttttgttttgttttgttttgttttgatacagagtctcactctgtcacccaggctggagtgcagtggcgccatctcagctcactacaaattctacctcccaggttcaagcaattctcccgcctcagcctccccagtagctgggattacaggcatgctccaccatgcccagctaatttttgtgtgtttttagtagaggaggggtttcaccatattggccaggctggtctcgaactcctgaccttgagatctgcctgcctcggcctctcaaagtgctgggattacaggcgtgagccaccacacctggcccatactaagttttttaatgcaatactttatcaaggtagaatttactcttaaatacctcctatggcttatgtgccagaattcagcttgggggagttccttagagatgttctcatagaaatctctacagaagcccccataactccataacttagcatccattctttccatacttactctttcctcttctgtcctgcattaggaaatatgattccctgattcaggatcaggcctgggaactgtctcacctatggcaaaaaatatgagaagggagaggtatttgttatcttatcacctggcatgcaaaagatacagtaaaatcttctgaggatctcctaaggagcaatgacattgactactacttgggacagagcttctgggagcaactcgcccagggaagccagctgacagagaggctcaccagcaaactcagcaccagtaagttggccacagggctttggaatactctcagtcacccccatagttccagcccctggtggccaccacatctccactgtaactttttaacctaggatcctgtttctatttcatttcctggggctaatatagaatgaagactgctcagtggggagcatggagaggaacacacagggctggagatgccatggttacaactatagaaacttcaccactcatggaatgtgacctgtggggcaggggcagcatctatctgatgctaagagggagtaggggacatgagatggaagggccttgttataggaggaagagccccgagctaagaattgcaagacccaagctctagcctggatgctgccaccaacttgctaaatgccttatccttgtggtgcctccatttatggcatggcaatgtacgtgaaggtactccatatatggataaagcgccatgctcttttatacatggtttaggcactggctgcagtagttcaagggctacattggttattattggggtcctctactcagaatttccagagaatatccaaaggagtaaagtaggatcagacttgggagccacctagcccacctcctggtggcagatgcagaggtggggcagggcttcttgtcatctcctcagagaccagtgcaggttctgcatgaaatctgtggtgggacatatgcattggggagctagtttgcaccaggactcggaggctggagtgtcccacagggcatctgggcaagggcctcatggttaatggaacaaaagacattttaaatgttttaccctgatttagggcagaggaagtcatgatggtgaccagcaggtcagggacagtgaggtcacttctctagagacacaagctgaggtctcccagaataactgttctggatgcacacatgaaatgctcactactctgtctccagataggctcctgcatttgtaatgtgggaagtgggaccagcctaatttcttattgtttctttctaaatttggtttgctgaggatcataaaagtgagaaagatcaagctggacttgagccactggtcctcaggtaattcagaggggaatctgggaaagagattgggactaaggcccaaagggtcaagggtggcggcaactccacaaatcaaggggaataaaggaaagtgctaaatgtattgaattcatgcattcattgaacacctcactgttgtttttaactaaattattccttcccttttggtttaatcacattggcacattaattctccaggcttagtaacctagaaacagtctgagctaaaagtgaactaactaggtttcaagagtcttctgccccactaagggtcacgctttcctgctgtgtgtttaataagtagaatgagctttttgcaaagttggcctgccccaagttgggttgacagctagtttaatagtcactcaattgccctgggggaaaaaaggaatcatataacaggacctggtgaaagaggcctagatggtgtagatcacaagaaggctgcagtgcctcaggacccagttctcagtgagttgcttcatataatgatcaatgaaatatgggctcagagtccattgtagccactagttggggttctttgtgtcatgcttgtgtctcagactacataaatgcttctgaaaatatctgtagtgaaggacacagtgttgttttttgttttgttttgtttttatttctaatccatcatagaaacatacatggtctgaattcacttaactatatgattccatttatcatgctcttggatgctggaacaatggtttgctctgcgtttctcaatgcttgctttcaatttttataattgtcttgttggagatggtaacaaacagttcgcaggctgcaactgttccagggatcatacattaagcagcagtgccttaaaaggagggctagctatgtctttgcttgtcttcggcatattatgtggccagagcactgggtagctattctttctccatctacaccccacctacgctccatccctaagcagaggtgggttatttctattattctctgcaggcatggtccccttggcttacttggcttttcctatgagccacagtcaggacaggttggtttgggcgaccctggttttacctgttgtcccccttctccccaccaggctcagcagggagctgcaggagaaggagaaagtgattgaagtcctgcaggccaaggtggatgctcggtccctcacaccctccagcagccatgctttgtctgactcccactgctttcccagcagcacctttttcctgtctgatgagctggaagcctgctctgacatggacatagccagcgagtacacacactatgaagagaagaaagcttctcctgctcactcaggtagcctccactttctgggtggtaccatctttgtctagactgagtggagaactcaggaaacaggacttatagctccatcatggtgtgtatcaggctgaacatggctgtggggccaagtgtcatgcacaagcaccagtggatcaggatctttgctctaatcctgactctacaagttacccctgtcaccctggcctccatgggcttgtacatgctgttgggcacaaggtgagccattgtggggagagtgagaagatcacagccgactcttcttcctcggcgactctgtcagacagatcttctttaagatggaaaacctccttcacctctcctacaatgatcttgctacttattcctgagcagtgttccctaaacatatgtgggtgtacacaaatgctgctagtcttgcctgataattttggagttgtcgttttcatgttccagagctcagagcaccactgtcgtccctaaggtggtttacctcactatagggtctgtctgcaagaaagaaaatgaacactgctaacagtgcttgtgcttggttctttccctgaaagcaagactctagccctggtacccctggctaaatataaggccaggattccagttctctgtagaacatcaaacgttttctttcattcatgggttttatagattccatccatcatttgagtcattctgctgtattgtcttctaaaccgtcatcaaccagtgcatctctgggggctaaggccaaatccagcagcaaccccatcagcttgccaactccccagaatccccccaaggaggccgaccaggcccattcaggtatgcaacagccaatggggcagaagcttcatctcctctttgatttttcttcaaggacagaggtttggactgttaggggcgtaaattcatcaaaacctagacagaatcaagaaaccaccctcattcaccaattgtgtctgatttaagaaaatattttagaaaataagtaatccacatcaggttttgatccgcacaccagctttgaccagtagttggctgaccatttaaaaagaaacatttttattggttttctctcattttatcctgggaggaaagaggaaaaatgtttctcccaggattacaacagccataggatgaaaagaaattcacatctactgatccactgtatgtgttacccattaaatctgcatggagatcctccccaagagacagtgctacttatttcatagccaaggacgctgagaacagcctcagacaaggttctgttcatagtacattaccattaatggatgtatgaatggattggcagtccttgatatgtacgtagtgcatatcttgggggcagttaaaagggtgcatttcatttacaagtccagcttagttgccagagggtacactgctcattcacagccctgtaccaggggtggcaaggaaaaggcaaaccttgtcttcacctcctacctcccaccatagctggctggctgccttcagtatggtttgttgtgaggtttgacttgagtagaggtgctcccagaaagcacagtgctttcttctgctgccctcatttccctgaaggcaattcaaccaaaatcttaaagaagaggaagtgttccaatgcttcctgagcctggtttcaaagtttctaggccagagtgggcagcagctggaccagaatcatgaagtaaagctttgcttccagaattgtagacatctgcttaaatgttttgggttcaaacagagcagaagatgaagaatggaggatttaaaaatcagaatgcctcctcaaagaatgtctgggctgtgttacctggcaatttgagtgtatttgcagttttgatctgaaatggtgtcagcactgttgggttgtgttttaggacgtaatcattgtcttctacattagacattctctatgggtcagccttggtttctgccccccaccattggctacctgccctttaattgcttttagggaagaggaaacaattttaaacattgaaacttgacagggcttctaaagatctatctgacagagtaaccaaggaagaagagtctgctgtgatcttctcactctccccacaatggctcaccttgtgccccacagcatgtacatgcccatggaggccagggtgacagaggtaacttgtagagtcaggagcagagcaaagatcctgatccactggtgcttgtgcatggcacttggacccacaaggtctctaaaaacttgtctgtaggtgggctgcctaaagatcaccagggaagactttttttaatacaaatttcctgttccaagaatttataattctgtaagtctacattaatgcctagacagaatcaagaaggcctaaagaatctacatatattaagagtttttgctatgtgatttaaatgcccagaagggtttgcaagccattttgtctaagccactctaccaaggcatctatttttaatttggtgattgaacacgttgatttggaattctgaagtttgtttccatcagagtcctcaactgcatgcactagtaatgaaaatttccccacagcctttgttcatctctctcctactcaggatgggacctgatgccatcagagaggagttctaggtggagaaagagtcttgtcccaaggccaaggactgatacatgctgggagcagagccccaggggcccttgagagcattcaggctctctgacttttccatgcccaggattgctggcgtggggctcaataatgccaccttaccttgtttagccaattgctttcaagatgaacacagaggttgtatgcaggatagccctggcaggggaaaagagggaaggtcagccaggccagattctctggtagcaatggtcactcttggctgtctcatcctgtaccacactaggtaatagccactctgcagggtgatgtctggttctcaatcttttgctcattcttttctctcattttgatgatgtgtctcttttctccctaactttctgtttctaggcattttcactccatacccaagctgactagacttcctcaggcaccattgccctcagctccatccagtttcctgcctttcaggcccactggccctcccctccttggctgctgtgagacaccggtggtctccttggctgaggctcagcaggagctgcagatgctgcagaagcagttgggagaaagtgagcacttctgcatttgtgtgcttgtgaatggcagccccacactgtgttgctctgcatggatcgggctggatggcagagttcaaagaaacaatatggggacatgttacaaatggaagactgagggaaagctctgcttgcttattttttggaaatgtatttcctgttatttctctgatgtgtgtctcatcagttaacaggtagatatgttcaagaggctctagacctggtgctttcacactgtagatagtgtaggataccaccaagtatgctgaatccctgacagactggtggactgctcattggtaggggatgggaggagatgttatgctttgcctatgcaggatgaagtggccaagaaaaagagggccacattcagtgggctcctttgtgtggctattacacttttctgctgtgaaatgctgttaatcaagttcagttcctgacatcattaggttggagcaaaaagggtaatggtaccaaagtgtcagctatggcatctgactgtgaatcctatcttctgactcccaaagataattgaccttatatagttatgtagactgtggacagtcaccttttagaaaatgctagatatatttgtaggctggatgctcatcataaatttagtatgctggtggtcattgatagcttaaaaaaaaagacaaaccttcacatgaatttgctctctcgtagcaccttaagcacaacagttagaaagcagtttgaatgaacttaaactcatttgtcaggcactttctgtgcctgcaaagaagcttaggtgagccagagactgatagggtcaccatgccagcagtttctagtgaagcaagacaacagccaagaatttgcatccccctccctgtagccctaaatgtcatgtggaccaacctatttctttccttcttcctttctttttttttttttttttttttttttttgagacagggtctcactttgtcacccagactgaagtgcagcggcatgatctcggctcattgcagccttgacctcctgggctcaagtgactctcccacttcagccccccaagtagctgggattacaggtgtgtgtcaccatgcctggctaatttttgtattttttgtagagatggggttttgccatgttgccaagactggtctagagctcctgagctcaagtgatcggcccacctcagtttccaaaagtgctgggattacagacatgagccactgcacccagcctagcctatttattttgtcaacccagcaaatggatactttgtctagtgcagggaactctaaagctcagggaagtgaagttacttgttcaaggtcactaggtgggagagatgggcttgaatctggtcttccgctccaggtttcacgtttctgttataccttttctgcttaggatggctttgtcaccatcctgcttagagtatggggctgagatcagctgatcaaactctggggaatccttgcaacaatttttttcctctctttagagaccagtaggaggtgctggtgtttctgacccaaaacttgttactttagcagttgtggcaccagcaatgggtgggcaaaaatgtcccccaagacaaatggcaagagtattttctagtttccatttcttcctcttgcctccttttcctttatctatccacatttgtccatttgtctttgcccaaagggaaggatggaaggagagcactgtccatgaaaaagggtctattgttttgggttaaattggaattacgtcaagtctgaggtcattgactggagatcaaatggtcccagcctagatgaggaagattgtagccctttctttctccacctgaagtcaaggtcctctccaagggccattgcttatccaagctcactgtttgcgttgagccaattttccgtgtggacagtggtgcatggcggcctctcaggtccctgggttaaaatcttgtgcaagagtctgtatggtatctttgcatggtttagagcatgtactgtgtattgtgtggccaatggactggaacatgagaatactgatcattgttactgatagacttaaaacctcacatggccttgattaaaaagtaagctgactatctacaaccactgatttctccctttgccttgtgtttggatggggttgaaggcagtttgaaagaggcaggaaatcacgtatttgttgcatcccttcaaaaatgtaggtgcttaaatttttaatcttcttccttaactaagtgatcctgatgaatatctagtattttgcaaattggaggagagactcatcacaagacttctcaaacttctgcctgttagaatcacctcagtatatgtttccatactttctcagatgattccaatatgtaccaacatttgagaaccagctacaaatggggctaaaagctggcaactggcaattacactaacccctccgaggagtttggcttggttggaagaaacaatgacctcactcctgttgcttaggaggagctacctgtctattctgctgcccatgttcataatccctgaaagaaagcaggcttctgaattttctcctaaattgcacttctgcccacctctttccctatctcctctatgctgggcttctttttacagagaagtggagatgaaggggctcaagggaaaggcctatgatttcaaagggtctatgaaagtatcagcctatgaaatgaaagtcctacctgcctctgtggaatagtattcaatgattctttagacaggagtgatgacattttgcagctctttgagtcatgttggatgggatccaaataaatacttgctttacataggcccttccccagcctcagcaaagagttcttcattctggaggaattagggccatcatatccagcttgacttcatgtcccctttctcttctgaaaaactccaaggtggaactgacatattgaccggttagtttcaggggaaggcaagtacatgtagacaaacaaacattcatgttcacaggtaagctcaatcctgtatgccgctgcactcacaacttgtaactgtgggagtgaatcctacttttagaactttccttggagtctgtcatgaaggattgtagtaggagccaggagcagggccactggacttttccattgtgtatactgatgactttaagatactttattctctacctcttgtgtctcctgctaggaaatacaaagggtgagaattacaacctctaggttacaagccttagtctaattggtataccacagtgaactgtgatctctgacattccacaggtctccttttagtctctattcttagtaatcacacacttccttgaaaatccttcccttctgacaccgcatttgcttcttactcatgtttctttctgcccaggtgccagcactattcctcctgcttccacagctacattgctgagcaaagacttggaagctggctcttcccactacctcaactctgcccagcctgactctcctccaagaggcaccatagaactgggaagaatcctggagcctgggtaccagggcagcagtggccagtgggacatgatgagtcctcagaaagggagtgtatccggggacctatcctcaggctcctctgtgtaccagcttaactccaaacccagaggtaaagcacaaagtggagatggcagcctttgaaaagaagtctcattcagagtctattcttttcctacccaggcaggactgtttcattcctcctccatccctggctcacagagtggggggtataaaatgaaagacctgtatcagggctcaatcctttccaagtacgttcttcattctcctgcccagggcctcagagctctgtagggatatgggaaagtcggggacccacctcttgtgctctcatactcatgtccttccatctctctgcagcctggactctttgcagcccagcctctttgcagcccactctcttagacccctctagaatgccaggcatagatgggactttcttccatcagtcaggagttgtcacaggaaagggtgcaagggtgcagctccccaaccctgcacatatatcctgtgaacaaaattcagtcacagcaagtggagaggtatagctaagctcataaatgctgggatgctactcagttccaacagtaagacaatcgtaattttcaggaaaagactgagcccaaagcaaaatggttcagttaatatccgacgtgagcatccctctgacttttctgcatctttttcctttgtttggctgggggaggggggtggtgtcatcccctctctaatctgccctcagatctctagatccttccaggctattctttcatcttccatattaaaagtgatttcagggaagcattcagtgtcagtcattaactgcatagggtgagtgtaagatcacatacttttactttaggccttctttctaagggtgggaggaagggctttgtcccttgctaaagaatgctcactcatgtgtcagtaagaagaaaggtagagtgaggtctcacctatcatcctcatagtcacacccaggaggtggccatacctttccagatgctaggcaggccttgtccagagccctcagttatttttctaaaacatgtggaactctcacaagacccctgtgtgggaggaggcccatggagatgttttagcaagtgactgttatgtgtttgaaagcacattgactgtttaaacaaactaccattcctttgggtgtccgtgtgacagcacacagttggcagaagactagtgatatttacaggtcttgctgcaaggcccctggctaggccccacacccaccagtaaccaggattctccatctcccacctctctccatgtcctgttggtttggctacagggactgccctggtggaagagcatcttggtgaaatccagaacttgcgccagcacctagaggaatccatctgcatcagtgaccacctacgggagcaactggaacaccagctgggctctactgcccatggaagtggtaggagaggccaagaccttcctgtttctggctctatttagggacctttaggcagagcttcacagatattctttacttcacttgctccttataaatagtccaacaagggaggtgggcaagtactgttatccctactttctgaatatatctgagtttagagagtaactctctttaaggcagaactagatctggtccccagaatcacctgacatctcaccccatacttaatctgcttatatactgcctgctgatgtatgtgcctttgttgcgtgattgataagtggtggagccaggtctgtaagggtcctcccaactccacccctggccactttaccaaggtggcctttctccttacactctccttccaagctactgtcacatggaggccagtctttccatatgtttttatcttgcctataccatagcagcagctgtttagggagactgagactcttgcaccattgcagttacggcatgtgatgatgcacgcaaagaatccactgagaagaggcacacagaaaacatgtacccagacccccatgcttcattcagggccaggccttgagtccttggggttttctgctgggttggggcagtatctttgagagataaagaatgggaaacttttggaagcttctgttacccaaaagtatactttctgggacaggatccacttctaacttctacagtcagggcctggagtccatacctcagctctgcaatgagagcagagtcctcagggaagaaaattgaagacttcaggctcagctgagtcatatttccaaaggtacatggtcaaaacccacaaactgtggtcactcttaagtttcgttcttccctggccacactaatcaccaactggagaagcaaatagaagaaggtagagataacagagctactcagatccaccaacccaaactcacagctattctcagtctagagaaggctgctttctaagatgtgccaactatgggcccctcagactcctagtccccaggagtgaagagctctaggaaatccatcatttctgtacaacccacctgcatatatccagagtcaccagctatcaatctggataccagtctggtatctgttctacctcccttcactcacaactgatttggaaccaataaaggagggagtgcaaatgcctatcttccctctcaactttctccagactttattgcagcagcatgtgttgctcctggccctgctctgccatacctctgcctcctcaccacatccctcactcatagactcagggctcctctctggccagtactcctatgactccatgccaagtggcaccagcaaatgccccccagcactttcccagccttagccagggggcactcacaggtgggcatcatttctcgtgtggctgggagacagctgaccttggtgttcgtctacttgatcaaatcaatgtattatcgataacaaagtatttttattcacaaatatttattgaactgccataaaaagactgagagtagtatccaaaaggattaagcccagaatgaaggaatgcttgtggaaaaggaaaacgccaccaagagatatttctaaattagccacctaaattaattaattaatttaattaattgatttctatattagcaagaaaatttgagaggaaatgtcactgctgggggacgataacaaaagttaacagataagaaagagggcagaactactaagctaccattgcatgcttggagagaatagaagagacctcacaggtgagaagacagtaagagatttaaatgaatacagtttgtcaggctcaggtgaatccttccccagaggacttactgagcccgcagctgtatttttagagtgtcttcaataatctttgacaacttgtgaagatcagagaagtgctgcaagttcaaaaaagaacaaatatcccagttttcaaaataatgaaagtgatatattccaaaaagaaatcttgatgttgatctttgtcaaaattcaagaatggattattgaacagatggtatgtgagcacttggaaaatggtgaacattagaaaccagaatttctctaaaagcaaggtaggacagattaagtgggacgaaaggttttgcagagagagagatgcaccattctccaggctgcggtggatgttgagccagcatgctcttccccaccaacatagggccttccttccctgctccttagctgtttgtcagggcagatgtgcttggggtcatcttcctgctgagctctgaccccatgataataaatcaatcctccgtgttcctctcaccagagcactcccaggaaatggaaagcctgagggaggctctgctgtcctctcaatcccaccttcaagagctggaaaaggagctggagcaccagaagatggaaaggcagcaacttttggaagacttgagggagaagcagcaagagttcttgcatttcagggaggatcgtctttccctccaggaaaatgactccaggtaagaggggacccattgacacagaaggtagcattcttcattcttacattcattcttacattagaagaagggatattggcaagacaattggtgtcctcttttggaaacctcaacgttccctctgctattcctgatttttgtgtgtcagttgttggataggaaggcgctttgagcagaagaaagtacttctctgggaatgccttgtcactcccaagttgagagagtaaaactctgttatagaaatcttcagtatatcagagacatgacaaggaagggttcccatgcttccaattaggtataggacattagtctcaccatcgcctaggaagcttctatactggctgtgatgctaggtcccatcataagccctgtaactgcttgtcagaatgaaaagagcactgtaggagcagtaaggagactgtgctggtgtatctgttctgctctgaactaatgtaggtaatggtgtgttttcaagcaaagttacttgacctccctcagccaccatttccacatctgcaaaataaaagtgatggtcttcatgaccccctgagttgacatctggggctcagatgtaaccctacccataaacctttatgaacccctgggttgacatctggctctcagcttattgctctggtgtgactgagtggccctgccatttcagtgggccttgccgctccctggtcagactgcagcacaagctggtcctcctgcagcaacaatgtgaagagaaacagcagctctttgagtccctccagtcagagctacaaatccacaaggcactttatggcaattccaagaaggggctgaaaggtttgtgttcttctccccttaccccatgaactttttgctcttgcataggatgctagtgaggtctttcctttgggagttgtggagatcatgggaagctacagagttctgtctcagaaaccccacccaagcctggggctcccagtaggaactctcatgcacaaagcccaaggtgacaggttggtagcacgagcaagatccagcctgatcattcttaattactttaagaaaatctggacattcccattctagacattcctatcaatgtctagaatataactttttttttttttttttgagatggagtctcgctctgtcacccaggctggagtgcagtggcatgacctcggctcactgcaagctctgcctcccaggttctggccattctcctgcctcagactcccgagtagctgggactacaggcacctgccaccatgcccagctaatttttttgtatttttagtagagacagggtttcaccatgttagctaggatggtcttgatctcctgatgtcatgatctgcccacctcggcctcccaaagtgctgggattacaggtgtgagccaccgcacctggtgattataacattttttaaagcaaaagaacagtcctaatgatatcatttgaaaaggcctctaatattgtcagtgatacatactgacaacccattcagcccaatgtagcaggcagtctgctcccaccctgaccctttccctagtgacatctggctctcagcttattgccctttcatttaattttcataaatcctgatttagtttcctgattttctaaagagaaggtgaactggaatttgaagaaatacaggggcttaccaggctcggtgaatagcttaagttcaaagtcatggtgagtgttgagtcagtggggaccagcctgcccacaggagaaaattaaaagacatgaaaacaaaaaaacttcatagaaataccactaataagacctaaatttcaatcctggatttaaatattaaggacattttttgaagactttgcttcctactgaaataataatctaatatttgagaattttgatatatttcttcattcttctttaaatggaggagagtactcaaaacataacgttaataagtcacagcaggctgggacagagggctgacatcaatgtcatgaaatttagcaaagattaaaagcaaaatcctgagctcgattaaaagtatcagtggtagaaatataggatgagcatagaaatataggacaggcagccattcatggacttcagggtttggggtttggtagaaacatgttcacacaagaatggcataggcaaaaggatgctagaaataccagctcaaaataacactacagtagtgtaagtgtgatgttcacctgtggagaccatgtctaaaatattgttagattatggggcaccatctttgaaaagggcattgacacactagggaacataatgaagacagggcgcacaatggtgtgtaccagacatcttgaactggtcaaagaaactaaagaaatttaggctttcaaaagatcttgaggacatgagaactggcttcagatatttgaagaactgtcaaggtgaaaaagaactcatgtattttatgtccctccagagggctaaacaaagagtgaagggcagtggaatttagattggaattatcataaatcctgatttagtttcctgattttctaaagagaaggtgaactggaacttgaagaaatacagaggggctcaccaggctgggagaatagcttaagtacaaagtcatggtgagtgttgggtcagagggaccagcctgcccacaggagaagcttggggtttggggagtgagaagtcaggatggtggagcagagtcatcaaatcttgaaagcccacaggtcagggggaaagttgacattctgtacagtagataatgaaactaagtctgttctttttcaaagaagataagtatatgatgaaaacagagctttcagatgctaagtctcaggggatgtcctggagttgggagacgttagaatctgggaaacctattggatgggtctagtgatattctggcacattaagagatgacagtctaatataaggtgctattgggaagatgaaagggtatagatagatttaaaaacatctctttaaaaaataagcaaaatttaatgagaacttggattgagaaagagagagagcaacatcacaaaactttgggcaaaattcaagagtagattatttaccaaagtctctaaaactaattcatcctgagctacctttcctttcatgcttttctccctgccttttaggactcatttcagagctacaaccactaaagctccataatctcttttttttttttttttaattatactttaagttttagggtacatgtgcacattgtacaggttagttacatatgtatacatgtgccatgctggtgcgctgcacccactaactcgtcatctagcattaggtatatctcccaatgctatccctcccccctcccccctccccaccacagtccccagagtgtgatattccccttcctgtgtccatgcgatctcattgttcaattgttcaatttccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccttgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatgatatctcattgtggttttgatttacgtttctctgatggccagtgatgacgagcattttttcatgtgttttttgactgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccatgttgtaggttgcctgttcactctgatggtagtttcttttgctgtgcagaagctctttagtttaattagatcccatttgtcaattttggcttttgttgccgttgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgtttgtttttctcaggtttgtcaaagatcagatagttgtaggtaagcggcattatttctgagggctctgttctgttccattgatctatatctctgttttggtgccagtaccatgctgttttggttactgtagccttgtagtgtagtttgaagtcaggtagtgtgatgcctccagctttgttcttttggcttaggattgacttggcgatgtgggctcttttttggttccatatgaactttaaagtagttttttccaattctgtgaagaaagtcattggtagcttgatggggatggcattgaatctgtaaattaccttgggcagtatggccattttcatgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtctgttgttggtgtataggaatgcttgtgatttttgtacattgattttgtatcctgagactttgctgaagttgcttatcagcttaaggagattttgggctgagacgatggggttttctagatatacaatcatgtcatctgcatacagggacaatttgacttcttcttttcctaattgaatcccctttgtttccttctcctgcctaattgccctggccagaacttccaacactatgttgaataggagtggtgagagagggcatccctgtcttgtgccagttttcagagggaatgcttccagtttttacccattcagtatgatattggctgtggatttgtcatagatagctcttattattttgagatacgtcccatcaatacctaatttattgagagtgtttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatgatggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctgttgattggaatagtttcagaaggaatggtaccagttcctccttgtacctctggtagaattcagctgtgaatccatctggtcctggactctttttggttggtaaactattgattattgccacaatttcagagccttttattggtctattcagagattcgacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgatttttagaagggttttttgtgtctctatttccttcagttctgctctgattttagttatttcttgccttctgctagcttttgaatgtgtttgctcttgcttttctagttcttttaattgtgatggtagggtgtcaattttggatctttcctgctttctcttgtgggcatttagtgctataaatttccctctacacactgctttgaatgcatcccagagattctggtatgttgtgtctttgttctcattggtttcaaagaacatctttatttctgccttcatttcgttaggtacccagtagtcattcaggagcaggttgttcagtttccatgtagttgagcggctttgagtgagattcttaatcctgagttctagtttgattgcactgtggtctgagagatagttggttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttcagcctatgtgtgtctctgcacgtgagaagggtttcttgaatacagcacactgatgggtcttgactctttatccaacttgccagtctgtgtcttttaattggagaatttagtccatttacatttaaagttaatatcgttatgtgtgaatttgatcctgtcattatgatgttagctggtgattttgctcgttagttgatgcagtttcttcctagtctcgatggtctttacattttggcatgattttgcagcggctggtactggttgttcctttccacgtttagcgcttccttcaggagctcttttagggcaggcctggtggtgacaaaatctctcaccatttgcttgtctgtaaagtattttatttctccttcacttatgaagcttagtttggctggatatgaaattctgggttgaaaattcttttctttaagaatgttgaatattggcccccactctcttctggtttgtagggtttctgctgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttgattccattctccgcatcactttcaggtacaccaatcagacgtagatttggtcttttcacacagtcccttatttcttggaggctttgctcatttctttttattcttttgtctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcgaagttttcaacttctttgcctttggtttgaatgtcctcccatagcttagagtaatttgatcatctgaagccttcttctctcagctcgtcaaaatcattctccatccagctttgttccgttgctggtgaggaactgcgttcctttggaggaggagaggcactctgcgttttagaatttccagtttttctgttctgttttttccccatctttgtggttttatctactttgggtctttgatgatggtgatgtacagatgggttttcggtgtggatgtcctttctgtttgttagttttccttctaacagacaggaccctcagctgcaggtctgttggaattccctgccgtgtgaggtgtcagtgtgcccctgctggggggtgcctcccagttaggctgctcgggggtcaggggtcagggacccacttgagaaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaagcaggcaggcctccttgagctgtgatgggctccacccagttcgagcttccccgctgctttgtttacctaaacaagcctgggcaatggcgggcgcccctcccccagcctcgctgccgccttgcagtttgatctcagactgctgtgctagcagtcagcgagattccgtgggcttaggaccctccaagccaggtgtgggatatagtctcgtggtgcgctgttttttcagccggtctgaaaagcgcaatattcgggtgggagtgacccaattttccaggtgcgtccgtcacccctttctttgactcggaaagggaactccctgaccccttgtgcttcccaggtgaggcaatgcctcgccctgcttcagctcacgcacggtgcgcgcacccactggcctgcgcccactgtctggcactccctagtgagatgaacccggtacctcagatggaaatgcagaaatcacccttcttctgcgtcgctcacgctgtgagctgtagaccggagctgttcctattcggccatcttggctcctctcaagctccataatctcttatctgtaatttcaaaatccagtaagatctccaaattaaatttttcaaatagtcatttagtgacaaaatctagatgaactgacaagaagatattcataagtctttatttatctacttagaatgttcacatagctcattgcagaaatagttatatgtttgattaaggattgtggctcacctgcaactgggtacatgttatatacgatatatgcaccctgttgccttgctaaaaactaaaacaaaatttactttttgagatacatttggccttaaggttttcagataagggattgtggacttgtagaatatttcttagatctcttcatccccagtacaaagaaataaactacatgtggtgaatggaggtaaatatatatacacatatatatttttatatatgcatatatatttatatatacgtgtatatattcatatatacatgtatatatttatatatatatgtgtgtatatgtgtgtacatatatatgtacatatatttcatatatacacatatatagtatgtatatgcacacaacatatatacacactatatataggtgtatatatgtacacacgtacatatatacatatatacatgtatacacatatacatatatactgtatacatatatatacacacacagagagagagagagagagagaagttgaaaaactcacttagttataatccctcgtctaagttgccgaactcatatcctcacatgctaccaaaaggcctcctccttctcctctttcatttttgagagtgaagactgtcaaatctctttctccttcatcccctacccttctctagctcagtgctgaccttctaccttggaggatcctatactttagcctacaggactaaggttactatggagatgaaatatggacttatccttatctgccaatcaaatgctctataggtgcatgtgtgtaacttaaaccacaaagaagtttcagactggatgtgtgccagctcagtgccatccccaggccacacacagaaatgatgacatgtccatcatagatgggttgcatgagactcagatgatagtggggtccttggcagaaaagagtgtcacagaggagggttctgacaagtgcttggaaatacttgggtcaatgttaccagactcctcttctctcttaggttacagcctggatgcttgtcaccaaatccctttgagcagtgtcctgagccacctggtgagagaggtacgaggtctgagagggcagctggagcaaagcattcaggggaacaattgtctgtgactgcagctgcgacagcagctggatagcggtgctggcaaagccagcctcagccccttctccattaacaagaacttcccagccagcactgaccctggaaacaaacagctgctcctccaaggtaggaaggaaaagggacttagaaagctctcagccagtggggagatcaccaggatgtctgcagcagaaggtgcaatctgcctggtctatgctccttagggtcaggttgaaatcagagatgctctagtctagcagcctgagtgaaagtgtgggatttaggccaggccaggctccagattctgagtttaccacttaaagatcatttgatttgggcaaggtgtttaaagtatcagaggtttaggccttagtttccttatatttaggataataataatatataccttatatgattttgagcattacatgaaatcatttacaaatgcttggcacactaagaattgctcaataattagtagctgtatatgttcatatctttttcttggatttgcttagtgctttagtattagcgaagtgttttcacatatagaatttcatctgtagtaaagcaggttttgctgtctctatttcacacaagaaaacttaggtcttgagatattaacagacaagcaagggtttagagaagttatagacaaagccaggatcagaaccagatgttgtgattttcagtctgtgttccttccagctcattgtgttctgtctcagtattgccgaccttcccagattctctagtccccctttccctcacaggtggggaactcagtgtgtggcaaaatgttcctgcccttaaggaaacagggctctggggaagttctggacggtgggcaatttatttcgggtggccatcattcactctctacccctccccttgcctgccttttcagataggcgtgtttgaccaggacccccttctcttctcgatatcccccatcaatctcacttctcccagttttaactgaaatgtcaatggtgtccccctagtcttaaatcattcaatttctacttcctctgtctttttttccttttgatacaccatttagtacaccatctccactcacctccatggccataccttcaattttattcaaatcaggaaccactgtttggtttcgctaaagctgagctttcactctcctgccagctatttctgggtcatgttaatcttcatttttctctggttcttgtagatgcttgtttatctgacagtaaccttatttgtcaaatgaaggtgacaataacatgattacgctgcgttggcaattcagtgaaaaaacacatgtgggccgccatgcaaaccgcctggctgccaggaacttctcagcttacattaggtggatgccttgccctcctctgggctgcgctgatagttgtggtgttcagttatgtctccaactcttccttctaaacaggccttcccctctcactggcttcccatacagcagccaagaagccccactggcacagtccctgcctctctttctctagcactcccgaggcctgagccagaaagcaggcactgggcaacacttgcctgagcaggaccttttctaccttctttgtgatattttcctattcctctaccatagggttgctttttagtctccagcaagacaatgttaacccaccaagacttccatctccgttctttagacacaagtacatttttttcagtattaccctcatcagaatgatggctagaaagttgagtttagtcccccatgaatccttttattatttgattctacattttaatatgtactatgtatatttatacatattacatttagttacagggcatcgtattagataccacacagagattatactcaagacttggtttataaaaatacacctaataatttttcaaactagaggttactttctcatggaacatccctcaattaaaggaatatctttttgttctgaagaatggaaacattctgaactcagtgactcgtgggattttgcttttcttttgcttgtggcgtacgcataattctgtaagaggagagtcctgccaccttaggcctcagtggggatggctaggtgtgcatgtgcttcatgtgcagtgtgttccagggctcctgaaaactgtggttgcctttactccccagattcagctgtgtcccctccagtctgggatgttggtatgaattccccagctctggtcctccccagctctgtttcctctactcctggctcagaaacagccataatcaacagaacaaatgctaaatatggcaactaaagggcccagggactgatgatggaaagtgattaacgcaaacaacctttttttgtctctaaacatattatctgtatttagagagttttctctgcatgccccaaggcctttagccctactcactgcaccttctgtggctggctttcttgccattattcatcctccaatagttttcctattgctgtttttgcttcattgcaccataatctctccattcttgaaaatgttctctgtatccagcttgatttccttgtctgtgtcttctctacccagaaacttattatttattatgatttgtcctatttcattagccaataaggaaaaaattgtctcctggaaaatttatctttaagacataatgtaagaaagattataaaaatatagaagccagaagatctctatggactttgccccagccttgcacattccaaggcttcctttcttgctccaagcctcttccttttcttgttccctgcctcttttgagttggagcaaactgaggatatcattatgaataacagaagattccattgtgttgtcattttctttttcaggcttgggtttggatacttctccagtaatgaagaccgctcccaagctggagagtgatgctactgatggcccctttgccaataagaatggccgccatgtcattggccacattgatgactacagtgccctaagacagcaggttgcagaaggcaagctgctggtcaaaaagatagtgtctcttgtgagatcagcatgcagcttccctggccttgaagcccaaggcacagaggtaatcacacctgtaggtttaggtgcactctttccctgtgccctttcttcctttgatgttaactgcttcacccacaatttttgtttttttctttttttcatgctttgccttcctcttccatgtatagcagccaggccctttcttctctatctcctattttcactctgagttctgctctgttccagatgtagctgactggatatttcccctcagccccacagaaacacgtggcattgcctagcagcctttggtagcttattatctactgcagtcatgcaggcacatgaccatctgtgggcacagtcgactcaatgggatggacagaaactgaaggatttgcaggtatatggcccccatatgtggaaggggtgagaagtctggcagccatggcatttccttgtgcagactgcatagggagagggaaggcaggcagcaaagcttgtcagagcaccttgccagtgagagagaccaggcaccatggctgtgctgtctgagctgctggagacccatgaatgcataggagcagccctgtctccacggaacccccacactagaggacaagacacacacccaagtagataagcacagtaaggggctacaggcacagtatgagaagtcatccctatgctgtgagagcgccgatgcaaatgtggtcatttatctcaggcgaggaaggtaacaggttcatagaggacacagcaagtggggtgagttttgaaagccttgtgggttctgcaggtggagaaaggcatacctggtaaagggagcagcaccttagttctgagtgctgcaaatggttgtgagagggcttcacaggttcaagcaggcccatgttctgtgcctcactcacaaaggaaacttgagcccatgcagggggaagaaagtaatctctccacttctgtggtgttacctttccccaggagcttggcagcaaaggcattcatgagcttcagagcagcaccagtgccctgcaccatgccctagaggagttggcttccctcctcaccatgttctggagagcagccctgccaaggacccacatccctgtgatgcctggcaaagtggaaagatgccagtgtcctttcttggttcaaacccagttctcctgccctctaatactgttctttctcctcaatgtcacagcttttccagaaaatcaggagccacatagtaagttgggatagacagaaacttagaggagtgtccctggagggacatctctggcccatggtggctgctttcattgcagctctaaatacatcccattccctgccagccccctggcccctggataagaaatcaaagaagaataggaaggggtgtggagaaggcagagacatcataaccctggcaatccataaatgttcagtttctttacctctctgaaatttggctgagatgaaattaagtgaaagcttcagcacccatctcccacccctcaggtcccatggtcaaatgatcacagaatgcccccatgagactgagcctttttagccactgcctggaatccctgcatatcacttaagctggcctctctggaccaggcctggggaaagtcagccacccctcaggatctgttcagagctcaggctaactctgattggcagaccctcatgtaggcaggtttcaggatcccctccccagggattctaactccagatcaatgtcaccaataccttttggatccaactatgctaattccagggagacggtgttttgccatcttcatgttggcacaaatatttacaaacttgcaaacttgcctgagtccagatctctctctccagcataacatttctgaactctcaatcttacctgtgaagggagagtgacagaactgatatcaggactaaagcaaggtcctcttcagatttgggagctttataccagcctgaagtgaggttctcttaagctaaaggtgtgtaggcctgtgctagtctgcatggggaattccagagtctcaatactcctgcctaatggcctcatccgaaactgtcctcagctggaagtattcgaggctgtgaaggaggaaatccatttcaggagagtggagaagattgtagaatccttctttgaattggaaagagccacaaagcacagggtgctttaggccttctgcctgttcagtaagagtctgtacctcttatcaagggagaattgacagaaagggaacttctggaactgagaaccaaagtatccaaacaggagtggctccttcaaagcatagctgagcatctgaagaccgccaaccagcagaaggagagcatggagcagttcatcatcagccagcgtaggttccctgagagggaatgggggaagaaacaggcagtcttcccgatgccccacttgtgctgcagatgagcagtgaccaggggggcttggggatgttgggagttgagactgatttgatgtccccaaacctcctgtgccatgagcaattgtggatgcagaggagaggaggatggggtggatagcaggagactccaagctgaatggccagaaagaaataaatgctttagaattctcatgctaagcaagtagggttaatttttgctggtgatttctactctgtggtgctcttttgttgtttcagtaaccagaacacatgatgttttaaagaaggcaagcactaacttagaggtaaggaaactactgcagcagtcagaggcaccaagcctgtccccaacccattgccatccgttagcatatcttgtaggtgacccttggcctgctttggccttccaggagaagattttgggtccacttgcaagatcacaggtcctcagtgagcatcctgctaatttctgttcccatcactctctcaccccgtcagctcctgccccagtattttggttcactctcacattgtcgtcatctctcctttttactccaatttttcttctttgatgccaagtcaggagactggagaaatgcaattcagctcactctcaaagtcattagacatccggaagtctgcctctgaatgagcttttggtagagggatcttgaggccagttatgtggtctagtcttcatgaaaaagtaaaagcaatttgcaacctaataaactgatttcactgcacactcctgtgttaagaacagcaatttgattttgatatatctttaagaaacatgacaaaagagatctgttgggtctcattggtctaaaagagaatttgttaataaataacaactgaatcttaaggggaaaaatgttatatatgtaccacatattctctacatttacttaaaacactaagtgttaaccgttccctaggaagtgctttgaagaaaaacttgaggtatatgaatggtttaaaaatcagaaactaaaccttttaacgtggacttcaaagctttgccataagcaattgagcatattcctagaaatatttctaaactgtaacctgagagaatgttgatctccatagtgtgaaaatagtgtgaaaatgacttgggccagtttaacttgctcttttttttttttttttttttcactaactcccttttgtttttctctgataattcttctctttcctaggcctctttagagcaacacttacaggattgcctctgtaaagccttattcctgtcccaggaaaggtaacccaaaaagtctcttgtatccactaaaaggtaacccaaaagtctctagtatccactggctttctccagtgtggaagctttcccctccacctcccatagatcactggaaaggacccgaggcctcggttctaatccctggcttatcactaactgctgtgtggccttggcttgtcctttaatctctatgagactgctgcacccttatctgtcaaagatggaactggacttagttgagctctgaggtccctgtggacttggcccctccacaccctcattgtggcaactggacataaacttaacagaggacccccctgcaaaatgtcctcttctttctacaacaggctgtttctgtatgtgcatgtttcatgctaagcacttctttcttgggtggacttggcaaagccctctttctgctgagacagtgatttggagagtcacctggcccctgaagagggagtggtaggatccagccacccagtgtgcagtgaatcggagcagggatctcagcacacagggaggtggggaggctccccctaacctcaggcacctgttgttcttcgagactgcagtgcatgctcttagctcatcctcttaactggctctcaccgtgctcctgtctttagtcaccccatagctctcactccagcttcaggtagccatcagtagggcctggcaatatacactgatttggtttgttttatttttgtctgcaggtgaaatccctaagagctctgccatgtactccttgtgacccttgccttccaggaaccatgcaagaagcgcagccaccagaagtccttaaaacagcaggaaacgtgggcctgtcccccttttgtgcagctacctatctgctgaggagcttctgggcctcattcctccaagtccacgggagggtccagaagagggggtcagagatgtatcctggtggagctgggagaaaaccagaaagcctttctgacagctatggaataccgttagccaaggtccacttggcccagcactaagcaaaagatgcgtagtttgcatagaaggttttgtgatactgcttcccaacagccccagcagcttgggaactagcaacaacacatttcttgcctcatcagctgtcctgagatggaaaactcagtggatataggaccctgattacgatgaatggggcacatggtcccaatgctggagctcctctggcaggttctaaaagcacactactgagcagcggtgccctgctggacactgctggcaggggctcagtgagcactactcacagatccacacctgaccctgttgggtccagtcagactgggccttggtctgcactgtagcacctgtgttctttgagttcacatcatgaatgtgacttcccagataccatttcaggcttaacctagcacatcctatttcttttcttctatgatatccaaattggactgacctcacttcaaatactctgtcccattttgtcaccctgtcttacctcagggaaattggggactgatggccagaccaattctgttgaaattcttgcatagagcaaacctgtgctgatttttaagtggcatgggagaggcccccagccacagtaaagcctagtctgtgtcttcacagtgttgatagaatctgcttgtgtgtataaatgtatgatatagatttacatatgttgctatcgccatatattgaaggccaacataactggtggacagggtaggtgagagaaaatgaaagtctttttggtgattattaaagcaaaatgtgtataaagaaataaatagtttttctttcactgctttgtttcccatttctgcaccaatcccttgacagtataaagaactggaaagagaaaatgggaaagacaaactgtgtttaagaagtgcatagtctaatgcttgaactctgactttaaaagattaaggttttccttctttgtcattttgtaagaatcctcagtctgaaaatatgaaagaatggttcttaaacttggtgtaccttagaagcagctgtgaagattacaggaactacctcctggtctccaatcccaggagatttagttggtgtgagccctagaatctgcattttttaaatataagcaccccaggtgattccattacatgtgggctgcagatcacagtttaaaaaaacagtgttctataacattgaatcaaaactaaaactacatttaaggaccttgaatcaaaaagtatgtcattccattaatatttgtataaaaattttaaaatattccttgggaaaagtccctagctacatgcttttgatccccaagattaaaataaagctatcacttcacaattatttactagaagcatttaaaaaataaacaggtagaaggtggagtaagatggtagaatagaattctccagcaatggtgtctctgaaggaacatcaaattgaacaactatctatgtaagaaaacaatttcacaaaggctaatcaggtgagagatcatagcagctggttttaacatgataacaagaaaagatgcattgaagaagggaggacggacacttttccattgcctatgacacctctcccccaaccacaggaaatgcatctccgagagagaatctaatggcttggggacaaggaggaaagtgtgggactttatattgaaacttagtaccagtcttgccatagtgacacatggcactggacaaaaccccacagcacttgattccaggctggtgcccacaaaagaagcatttagacccactctgggccacaagggaatcagatgccccagcaggaagaacccaccaaagttctggccggctttatctctggaaatttattgggctacaaataaatttcagtggcagccaggctgtagttcagaggtgacagcatgctggcagccctcacagccctcgctcactctcggtgcctcctcggcctcggtgcccattctggccgcacttgaggagcccttcggcccgccactacaccacgggagcccttctctgggctggctgaggcaggagccggctccgtcggcttgtggggaggtgtgaagggagaggcatgggtggaaaccgggctgtgtgagacacttgggggttagctggagttccgggtgggcatgggcttggcggccccgcaatcggagcgggacttagcaccctgggcagcagctgcggagggtgcgccgggtgccccagcagtgctggcccaccagtgctgtgctcgatttctccctgggccttagctgcctccctgcggggcagggctccggacctgcagcccgccatgcctcagtcccccacagtgggctcctgcacggcctgagcctccccaaggagcgccgcctcctgctccatggctccaggtcccatcaaccgcccaagggctgaggagtgcgggtgcatggcgtgggactggcaggcagctccacctgcggccctggtgcgagatccactgggcgaagccagctgggctcctcagtctagtggggacttgggagaaactttatgtctagctaagggattatgaatacaccagtcagcactctgtatctagctcaaggtttgtaaatgcaccaatcagcatcctgtgtctagctcagggtttgtggatgcactctgtatctagctaatctggtggggacttggagaatctttatgtctagctaagggattgtgaatgcaccaattggcactctgtatctagctcaaggtttgtaaatgcaccaatcagcactctgtgtctagctcagggtttgtaaatacaccaatcaacactctgtatctagcttatctagtggggacgtggataacttttgtgtctagctcagggattgtaaaggcaccagtcagcaccctgtcaaaacaaaccaatcagctctctgtaaaacagaccaattggttctctgtaaaatggaccaatcagcaggatgtgggtggggccagataagggactaaaagcaggctgcccagccagaagcggcaacctgctcaggtccccttccacgctgtggaaagtttgttcttttgctctttgcaataaatctagctgctgctcactctttcggtccacactgcctttatgagctgtgacactcactgcgaaggtctgcagcttcactcctgagccagtgagaccaccaacccacgagaaggaagaaaccccgaagacatccgaacatcagaaggaaaaaactctggacacgccacctttaagaactgtaatacccaccgtgagggtccgtggcttcattcttgaagtcagtgagaccaagaacccaccaattccagacacatagtgactgcagtccttgggcaagccctgaagctgcataggtctggaagaccctagacttgaggtgtaagccagtacgacagcagcagggcagcagctatgggaatgtctgtatcacccctcctcacactccaggcagtgcagcctgaagagagattccttttgcttgggggaaagaaagggaagtaagctagaggctttacctaggaatgtagagaacaatccctgaacttccccaagtccacagggctggggacctaggaatctataagaattgcagtgtacctgggctttgaatgccctgtagtataagaatggctgcagtgatcactggcttagggaactcgtcagcccactttgaattcctggaaggtcctctgaaggacaggtacaaacaagacctgactgcaaaggctggaataaataccatattctccaatgcccagatattgaccaacatctacagtatcaataacatttaagtcaatatgacctcaacaaatggaccaagtaaggcacccagtgaccaaccctggagaggtggagatgtgtaacctctcagggaattcagaatagctattttgagaaagctcaatgaacttcagggaaacacagagaagcaattcagaaatatatcagaaatttaacaaggatactgaagtaatagaaaaaaatcaaacaaatcctgggctggaaaatgcattagtgggtctcagtagaactgatcaagcagcagaaagaattagtgagcatgaaaacaagctatttgaaaatacagtcagaggagaaaaaagaaaagaagaacgagaaggaacacagaatgcttaagagatctagaagagggcctcaaaagagaaaatcaaagattcattggccttaaagagacggttgagaaggagcaaagagtagaacccttattcaaagaaataatctttttttaaaaaatactttaagttctagggtacatgtgcacaacgtgcaggtttgttacataggtatacatgtgccatgttggtttgctgcacacaccaactcgtcatttacattaggcatttctgctaacgctatccctcccacagccccccaccccacaacaggccccagtgtgtgatgttcccctccctgtgtccatgtgttctcattggtcaattcccacttaagagtgagaatatgcggagtttggttttctgcccttgtgatattttgctgagagtgatggtttccagcttcatctatgtccctgggaaggacacgaactcatcctttttattgctgcatagtattccttggtgtacatgtgccacattttctttatctagtctattactgatggacatttgggttggttccaagtctttgctattgtgaatagtgccacaatgaacataggtatccatgtgtctttatagtagcatgatttataatctttagggtatatacccagtaatgggattgctgggtcaaacggtatttctagttctaggcccttgaggaatcaccacactgtcttccacaccggttgaactaatttatactcccaccaacagtgtaaaagcgttcctatttctccacgtcctctccagcatctgttgtttcctgactttttaatgatcgtcattctaactggcatgagtggtatctcattgtggttttgatttgcattccttaaatgaccagtgatgatgagccttttttcctatgtctgttggctgcataagtgtcttcttttgagaagtgtctgttcatatcctttgcccactttttgatggggttgtttttttcttctaaatttgtttaagttctttctagatgctggatattagccctttgtcagatggatagattgcaaaaattttctcccattccgtaggttgcctgttcactctgatgacagtttcttttgctgtgcagaatctctttagtttaattggatcccatttgtctattttgactttcgttgccattgcttttggtgttttaatcatgaagtctttgcccatgcctgtgtcctgaatggtattgcctaggttttcttctagggtttttatggtgttacatcttacatttaagtctttaatccaccttcagttaatttttgtgtaaggtgtaaggaaggtatccagtttcagctttctacatatggctatccagtttccccagcaccattcattaaatagggaatcctttccccattgcttgtttttgtcaggtttgtcaaagatcagatggttgtagatgtgtggtgttatttctgagggctctgttctgttccattggtctatatctctgttttggtaccagtaccatgctgttttggttactgtagccttgtagtatagtttgaagtcaggtagcatgatgcctccagctttgttcttttggcttaggattgtcttggctatgggagctcttttttggatccatatgaagtttaaagtattttttttccaattctgtgaagaaagtcagtggtagcttgatggggatagcaatgaatctataaattaccttgggtagtatggccattttcatgatattgattcttcctatccatgagcatggaatgttcttccatttgtttgtgtcttcttttatttccttgagcagtggtttgtagttctccttaaagaggttcttcacatcctttgtaagttggattcctagatattttattctctttgaagcaattgtgaatgggagttcactcataattttgctctctgtttgtctgttcttggtgtataggaatgcttgtaatttttgcacattgattttgtatcctgagattttgctgaagttgcttatcagcttaaggagattttgggctgagatgatggggttttctaaatacacaatcatgtcatgtgcaaacagagacaatttgacttcctctttttcctaattgaatacgctttatttctttctcttgcctgattggcctggccagaacttccaatactacattgaataggagtggtgagagagggcattgttgtcttgtgctggttttcaaagggaatgcatccagtttttgccctttcagtatgatattggctgtgggtttgtcataaatagcgcttattattttcagatatattcaatcaatacctagtttattgagagtttttagcatgaaaggctgttgaattttgttgaaggcattttctgcatcatttgagataatcttgcggtttttgtcattggttctgtttatgtgatggattacgtttattgatgtgtgtatgttgaaccagccttgcatcccagggatgaagccaacttgatcatggtggataagctttttgatgtgctgctggattcagtttgccagtattttattgaggattttcacatccatgttcattggggatattggcctaaaattatctttttttgttttgtctctgccaggctttggtatcaggatgatgctgccctcacaaaatgagttagggaggattccttctttttctattgattggaatactttcagaaggaatggttccagctcctctttgtacctctggtagaatttggctgtgaatctatctggtcctggaatgtttttgcttggtaggctattaattattgcctcaattacagaacctgttattggtctattccaggatttgagttcttcctggtttagtcttgtgagggtgtatgagtccaggaatttatccatttcttctaggttttctagtttttttgcatagaggtgtttatagtatcctctgatggtagtttgtatttctgtgggatcagtggtgatatcccctttttcattttttattgcgtctatttgattcttgtctcttttctcctttatgagtcttgctaggggtctattttgttgatcttttcaaaaaaccagctcctggattcatttattttttgaagggttttttgtgtctctatctccttcagttctgctctgatcttagttatttctgttttctgctagcttttgaatgtgtttgctcttgcttctctagttcttttaattgtgatgttagtgtgctgattttagatctttcctgctttctcttgggggcatttagtgctataaatttccctctacacactgcttcaaatgtgtcccagagattctggtatgttgtgtttttgttctcattggttccaaaaaacatctttatttctcccttcatttcgctatttacccagtagtcattcaggagcaggttgttcagtttccatgtagttgtgcagttttgagtgagtttcttaatcctgagttctaatttgattgtgctgtggtctgagagacacattgttgtgatttctattcttttacattcactgaggagtgttttacttccaattatgtggtcaattttagaataagtgtgatgtggtgctgagaagaatttatattctgctgattaggggtggagagttctgtagatgtctattaggtacacttggtccagagctgagttcaagtcctggatatccttgttaagcttctgtctcattgatctgtctaacattgtcagtggggtgttaaaatctcccattatgattgtgtgggagtctaagtctctttttaggtctctaagaacttgctttatgaatctgggtgcttctgtattgggtgcatatatatttaggatagttagctctccttgttgaattgatccctttaccattatgtaatggccttctttgtctcttttgatctttgttttttaaagtctattttatcagagaccaggattgcaacccctgcttttctttttgctttccatttgcttggtagatcttcctccatccctttattttgaggctatgtgtgtctttgcacgtgagatgggtctcctgaatatagcacactgatgggtcttgactctttatccaatttgccagtctgtgccttttaattggggcatttagcccatttacatttcaggttaatattgttatgggtgaatttgatcctgtcattatgatgctagctgtttatttcacccattagttgatgcactttcttcctagcattgatggtctttacaatttggcatgtttttgcagtggctggtactggttgttcctttccatgtttagtgctcccttcaggagctcttgtaaggtaggcctggtggtgacaaaatctcttagcatttgcttgtctgtaaagtatcttatttttccttcatttatgaagtttcgtttggctggatatgaaattctggattgaaaattcttttctttaagaatgttgaatattggcccccactttcttctggcttgtacagtttctgctgagacatccgctgttagtctgatgagcttccctttgtgggtaaccctacatttctctctggctgcccttaacattcttttttttgttgttcatttcaaccttggtgaatctgacaattatgtgtcttggggttgcttttctcaatgagtatctttgtggtgttccctgtatttcctgaatttgaatgttggcctgccttgctaggtttgggaagtactcctgaataatatcctgaagagtgttttctaacttggttccattctcctgatcactttcagatacaccaatcaaatgtggatttggtcttttcatatagtcccatatttcttggaggctttgttcatttctttgtactcttttttcttgaatcttgtcttctggctttatttcattaatttgatcttcaatcactgatatcctttattctgcttgatcgaattggctattgaaacttgtgtatgcttcactaggttcttgtactgtggttttcagctccttcaggtcatttaagctcttctctacactgtttattctagttagccattcatctaaccttttttcaatgttttcagcttccttgcaatggattaaaacatgctcctttagcccagagaagtttgttaataccgaccttctgaagcctacttctgtcaccttgtcaaactcattctccatccagttttgttcccttgctggtgaggatttgtgttcctttggaggagaagaggtattctgatttttggaattttcagcctttctgctctggtttctccccatctttatggttttatctactactttggtctttgatgttggtgacctatcgatggggttttggtgtggatgtcctttttgttgatgttgatgctattcctttctattggttaattttttttctaacaggcaggcccctcagctgcaggtctgttggagtttgctggaggtccactccagaccctgtttgcctgggcgtcaccagcagaggctgcagaatagcaaatattgctgcctgatccttcctctagaagcttcatctcagagggacacccacctgtgtggggtgtctgttggcccctactgggaggtgtctcccagtcaggctatatggtggtcagggacccacttgaggaggctgtctgtctgttatcagagctcgaatgtcatgctgggataaccactgctctcttcagagttgtcaggcaaggatgtttacgtctgtagaagctgtctgctaccttttattcagatatgctttgcccccagaggtggaatctaaagaggcagtatgccttgctgagctgtggtgggctctgcccagttcaagcttccctaccactttgtttacactgtgaccatacaaccacctactcaagcctcagcagtggcagaacccctccccctgccatgcttcagtgtatcaggttgatctcagactgctgcactagcagtaggcaaggctccatgggtgcgggacccaccgagccaggcatgggagggaatctcctggtctgtcagttgtgaagacagtagaaaatgtgcagtatttgggcagaaatgtactgctcctccaggtacagtcactcacagtttcctttggctaggaagaagaaatctgccaatcccttgtgcttcccaggtgaggcaatgccccaccctactttggtttgtcctccatgggttgcacccactgtccaaccagtcccaatgagatgaacctggtacctcagttggaaatgcagaaatcatccatcttcagcttcactctcactggaagctgtagactggagctgttcctattccaccatctttgaagcaaccgtctttttttttttttttttttttttgtatttttggtagtgacagggtttcaccatattgcccaggctgcgtttcaaactcctgaggtcaagccattcattaaaacaaacctatatttgttttatctgagttccttcctcaggaaaggaccctcaggcctctcagaaagcatcatagacctgaaactcagctgatcacagcctctagacaactagatgccagaaccctcactcaacatgagtgcttcctcaccactccctagttcctcttttcccacacacagttacatttcttccctgctatataagcccccaactttagtcaatcagggagatagatttgagactaacctcccatctccgcagccacagcaccgatcaaagccttcttcctcagcaatactcaatgtctcaatgattggctttctgtgtgctgagcagcagggcctacactgaacccctggggttttggtaaaaatacatgtaccctttcaaaaaccgcaattaatgggttgtggcatattgaggaattggaatggcgtcaacttggccgattctgagaaaacacactgtgcttaagtgtcagggccctgcctcctgaccttggcagtttatggttgattttgaggcacagcaggggtgtgtggcctggtttgagtgttttatagaaatgtaaaatatgactgatttatttgtattttaaattcaacaaatctccatttctggtgagaaaatcttgccaaaaccaactaaacaaaggcatagacgtatatgaagaagaaaataaaagactccttgcctcccaatcccacttgcttggtgtcagccattatttattacatggaggaaggggacaaggcacccaggaagtcccaagtcctgttctgacaatcatgtggcctcactggacaaagggaaaagagggaaggcaaaaagaatgtaacactacagtttgcagaaatttccctttggtagaggaaacactggtaagctgagagagtatgttttccaggagggaggcctcaaagggctcttctctggccctaagcccaaactggattttgcctcattttctgaggtgcaaatgaaatgataaaagttgatcaaaggagagggcagagagaaagaaagaggacaactcctctctcgcaggtccaccttccttggtgctgcttgagggatcagaagaaatgccttaacataggtgcatgagaactatggctgctaaatatgaacttagttacctccagttacaagctagtgtgaggttccatggtgtaatggtgagggctttggactctgactacagtgatcagagttcaagtctcagtgggacctttctgtataattccagtgaggttcctctctattgctcccgagtggaatgggggaaattgccgcaatcgtggtcatggaccctccaggccactggctatatgcaattggagtcctggacccagtgacccagcaagacccctcccctctcagggtgaccctgggcttccaggtcagaggtctcctccactaaaaaggctgccttccctcaatcctagaccccgagttttcttttactcatgtcatcgggccgctgccctgtgtctctttggaagaaattacctacgtgaaaaactttactttcaggattccctaattccttcatcccataggatggtgaagtttttaattcctgatattgggtcaagttctaatgcgcacattgctttttgttttcatgggatcccttccaaccagctaccagtggatttctgtcttggggtctctgtggatggcaactagatgctgctcttgtctgaactcctgacacctctctgcagggaattgcctcccttagcctcctaaatcagtcaacatttagatttgagcctggaatcccagcatctgtggagaacagaggttcctgatccctggccagctctccctcagtgaaggggggaggaagagagcagctgtaaggtgcaagtctggggccctgggcaacccccttcttcctgcccagactctgctccaaggagaagttgccttaggaccagatcagatggaaactcttttgttctcttctcatcaacagaaaaatttagacaagaactctggaggaccttcctagcttatacaaatggtgtggccaaatctctccagttttggaaatgtccaagtttaccaagtgttttgagggctcactttggagcctctgaaaaggaggggtgagggcccacggaaggtacctgagggatgcaggggagagaggggaaaaagcagacagaagggaggagagaaggagggagggggagaaagggtgtgtgagggccaggagccaggattcaccctgacagttcagtgactgctccctgcccccaaggttcccactgtggcaccttccagcaggtggtttccatctcttattgatatcctaagaacttggtcctacggaacagtcccaccctatttgtctggcatgagtcctggcagtttcttttcatcttttgggggatcagatgggggtatataggtttgcaagtgacaaggagctaagtcaggaccttgtgaagctgctcagagttaactgtcaagcagcctcctttcccccttcccctgaaggatgattgcctgcaagacagggcctggaggaggccagggcacccaaggccacagaaatgccctgggatgagtcccggcaggagatgccttggctgagctgactgtgcacttccagggctcacaggggtctggccaggagactgagcaaggggaccagggaggttatgcagaggcttctgcacagcaaagcagacattcttcttggagcccccaacccaaatcaggtcttccacctcctcttcctaaagaccctttactgcagctattcttttactagaactacaagtttataggacatagatttcagtgccctcatctggccaaccatcttcagctgccaatgcccagggtaacctccctccctaccaagacctgactcaggaccttaccttaaggagaagatgtcctgttctttctttcccacaagaactgccctagctcagaccccatttctgtctggtgaccaggacagtcccctcaccagtctcgcaggttggggagggcagattctcctcagctccctgcccctgagagaccccaagagtcttgtgtggctccagcccacagagggatatccatggcccatatctctcaaaactctcccctcccactctgaatccaccctctactgcatgctcccctcacagaacagacactttttttttgttttttgtttttttttggcctatcctttttttgcctacccgcatcccagattgacttttctgtcttagaactacctttccctctttggacagtgtttttctggtatacacatgaagatgtcccactctcccctgctcaagaagagagtgcctgacctaagctgggcccatcagatccagtacttacctggaataggaaaaagacggggagggtgaccaaagattacaaaaatctctgaagcttatccacttgagaaagagtccctgaagatactggcctttcattcctgctatgtatatccaatgtgactgaactctgaataaaatatacaagttataacaatgtagtaattgacccagcaaactaggacataaacatgttagagggtaaggtagtgagaggcatgtttgggggtggtggtgatgagcaagtatgtgaaggagagatagtgcctaaacttgaaaatcaaaaagtaataatatatatttagacataaggagataaataactaataattgtttctatgtgatgaaactctgggagtatacaaagggactgctgttgtactaaacaaattttctagtataaataactttgacaaagtatccaaataaaaaaatcctttctcatatatgtatgtgtgtgtgtgtatatatatatatatatatacacacacacacacacacacacatatttgcattctttgcattttgaatataaatttttatacagtcatgttaatccctcttttcttttaaggatttgagtttgatgtcatgcatacaatgtgatcccactgtatgactacagaaatgttagcaaagtaagttcagaagacatggtaggaaaatacttcccagttttggccagaagatggagaaaaaaagaattctcataaaatgttaaaagtatgacttgttatatcttcttttcacagtaatttagacagaaattagcaaaatcagaaaggtatacatactttggtctgacagttccatctccaggtgtctacggagaaatagacaagcgatgcatgacagatacatgtgtcagtctggtccctgcagttgtatttgtaataatacacattggagcaatttcatggccattggttacagaatgtttgaagaatgatccattcatatcaagaaggatatttcgaagatctaagcctgatggaaatgctggaggccatgacactgataggagctcatgcgtgttgaccaattactacgtgacaggcattggctccacgctcatttaaattttggacaacctacgtgttctgatttagcctattggacagcaaatttgacagaaatggaggcacagaaaattaatgtgtttaacttcaaactctggtagattaggtttttcacccagagcctgtggcttcaccatagttgtgattcaggttctgtcattttccacttcaggaatttccagtattccaaatatgagaagctgagaaaacaaacaaaccaactcaaaaccctaaaagccaggataagtaagggtagatgtttgttgggtgtggattaaaaatggacttttttttgcctcaaacaacaaagaggcacgtcggaaaatagacaagagacaagaagaagagatttaagagatatttggtccaaggaagagactcttcagatggaaggtcatgtcagctagaaacattaatgtgactggatgggctcaaaccactgacttttcagtcaacatctgacagcactaacctaatgtttcagagacactgcttgttaaacagtgaaagctgttgctcaattgtgtcatccataattgtcaaatattgccatttagtagcataaggaagtattctctgttgccaggctagagtacccgtaactcttctgttttgttgaacattcttccccaccacaaaccctctttagaagactgggggctcctaaaacattgaggctaagagtcctgtccttgtgcatgtttgggcattgacccagggccaaatcagtggtagactcctccatgcatatgccaggtccccaggtgacaactgcagtctctggatctgaggtcatccactttcccattcctagctcacctcgcccattgtgaagcctggttagtattgccagagacccgagtggacaggtgcccccaccaaagacagaacctgccatgtgcccatcttgctgatccctccatccttctagacaaaggcttcatgagccagggaccttgggtttgctcacaagacagcccctcacctagtatgcattagctcattatgtgtatgtatgtgtatatgtatatgtatatgtatatgtatatgtatatgtatatgtatatgtatatgtatatatgtgtatgtgtgtatgtatatgtcctcaggttgtattccttaaatatatatatgtaattccttaaatatataattttaatatgaaattttaaaaaggttcctttaataaacatttacaataacatcaagaaatataaactatatagcaaagatgtgaaagccagccaggctctcaatagcatcaagaaatataaactacataggaaagacatgaaagccagccaggcttggcttcaaatcccaacactttggaaggctgtggcaggatggtcacttgagctcagaagcttgaaactatcctaggcaacatagtgagaactcatttgtattgaaaatcagaaaaattatcccggtgtggtggtgtgagcctgtagtcccaggaactcagtggatgaggccctaggatgtcataggcctgagaattccatgctacagtgagctgtgatcatgccactgtactccagcctgagtgagtaagatcgtgtctagaaacaaaagaagaaaaagaaaagatgtgaaagcctatatattgaagactaccaagtattgctgagagcagttaaagacatttggaatagagaatgctccttcttacatttcaagattgcttttgttttggggggacacttgctattttttgagaatatgaagttcttcttaggcattcctgtaaaaaaggccactttttgataggattgtattgaatctgtggattgcttttagttgtatttttatcttaaccatgttacaacttccaacccatggacacaagatatctttccatttatttagctcttccttaatctccatgagcagtgttctgtagctgtctgtgtacaagtactgcacctccttgataaaaattattcccaggcttattatccttacaggtgctattacaaatgaaattgtgtcaattttcttctcagattgttcattgctaacacaactgattgtttgctgaaagtttgctgaattcacttactaactctagtagtgtgtgtgtgtgtgtgtgtgtgtgtgtgtgtgtggtctctgtgtgcatgtaagtgtgtttacatttgtatgtattatttgggattttctatatataggatcacaccatctgcaaattgagatcattttgttttctgttcaaaaatatttttctcatgtttatttttgaaagataatttggccaagtgtagaactgtagacttcagtttttctttttttaagtactttattgcaaacttcttgtttgtaaagtttcctatgagaaatcttatgccatccttatatttagtgctctgtatgtaacatgttctttccccttttattccttttaagatttcctttttatcactggttttgatggatttgattaaagtgttccttggtgaagttttcttcatgtttcttcttcttagaataatcgtatttctgtaatatttgaagtttatagtttccatggagcttctaaatctttcatccagtatgttttaaatatctttgtttcccttctccactacacgcccttcagggtttccatttatccttataccaggatgtttaacgtttttatgctgatggtctttttatgttttcaagtcatttgttacagtgtgtttcacttatgttagtttcaacttctattccagctagttcaataatcttctcttctgcaatgtttaatccagtgtcttcttccatttcatactgtaaatcatagttcttatctacagaatttaatatttaaaaaatcttcaacctctccatttaattaaaatacaattatactaactgctctaatatccttttcttctatttccaacgtgtgtcaatttcaactagattattagattcttcattgtgtgttaagttttcctgcttctttggctgcttgatattcttttatttttgttttttttttgggaggggggaggatggagtttcactctcattgcccaggctggagtgcaatggtgtgatcttggctcacagcaacctctgcctcccaggtacacaagcgattctcctgtctcagtctcccaagtagctcagattacaggcacgcaccaccatgcccggctaatttttttgatttagtagacatggggtttcaccatgctagtaaggctggtcgtgaactcctgacctcaggtgatccacctggctgcttgatattctaagatttgatgctgcagctttggtgtcaatgctcaaaagtgcccaaagacaccacttgacctcagtgtctatgcacacccaagcttttgcaacaggacaggtagagagggcagagatgagtgtgctacaacatgctggtagagggcacctcaattttgcttggggctttcctatgtttcatagaaaaatgtgttttccttaatttttcccataagaaccaccctacttcatgccctgtctctctgtccaaacaccaggacagtcctctcaccagtctcaaccacccaatggattgacaaatgtccaaatatgattcagtggagaaggcattctcttgtcaacaaattgtgtagaaacaactggacatgcatattcccaaaggaaaaaaattcacctgaacctcaatactgactcaaaaactaactcaaaaaggattatgcaactaaatataaactataaaactagaaaaagtatagcagaaaatgtaagacaaaatcttcatgacacagagttaggcaaggtgttctttgttttcaataaacacaaaccattaaagaaaacattgataacttcaactttataaaaattaaaagtttttgctcaacacaagacagtaataagagaacaaatataagctgcagattgggagaaaaacagtggaaatcacaaatatgacaaacggcatgtgtgatagttacttgtacttgtcactgtgaccgagcaccatggtactgggacatttggccaaacatgattctggttgtgttccagagagtgtttcggatacaattaacattgggatgggcagactaagtgaagcagattgccctccttaatgggggtgggactcatacgtacaatcaaatgccaggagacaattaagaggcctaatggaaaacaaatgctttcctgggtatccagctttccttccatcttcggaatttcagcctctataacctcagaagcaaattcatatatatatatatatatatatatatacacacacacatatacatttcatagttatgtggctaagattgtatttttaaaagttcagccatgagatgattggtgaagccagtcaatgaataagggtgtgttctattatatgattcagtcttcttttgtacacgatttaagttctgcatttgaagtaggaggatgggagagagtaagtccacctaggatgataacagttgaatttctcaacatacacttcaaagccctagaggttaacttagagagtcaaaaattccacccataatcctgcccctacacactagggctagggaacactgtggctctcaggtgattttatttagccaggtctgggagccacacaacagcagacggagcaggaaacactatgcaaatagaggccaggacagcagggagagcctgttaatgacagaacacaggtaaaactatcctcagaagcaagtgtggagaaacacagatgatgcctgagacctggtggattaaagcactggctactggggaattgaaaggaaggggcttcaccatgcagaggaccagaagtgccaatcttggaaacgcagaattcctgggagatggggaggcgtggaccatggaagtatcctctggagactcgtggtgaagagaacaaatgaatgaagtaactggcagaaattagagttcctggtagaacaaaatacaatcccacaatgagaacatacaccatgtatgtcccccaaggaagacaatgtctcctaaaaactcaagaaaatcattttgggcaagcaccttatatccagtaatgcgatccatgttttaagactgtgagaaaagattattaaacatgctaaactcagtgagatccaattccctcaggaggactctgttaaggatgagtaccactcagcaagtgatgactgtgacattcacttttggacagctcatgagcattaatatatttaattgtggatctaaactaaaaaccaaggtggagacaagatgacaatcacagaatgtcactggtatatgtttagcttcaaatactattatgagaagtaacaggtaaaggaggtgggaaaaagaaaacacattatgtaactgactgtcatatggaaatatttgatgctgaaagttataatttaaaacgtataaaccaaatattagaagtgtgtctagttcaaaggggggaaaccatcaaaaacatttttagtgcaatatttagcatgagctctacaacgcttcctaaatgtcagaggcacacacagacacacacacacactcactcacaaagaatacaaataattggaacccagaaaagtagtaaatacattctgctacatatggtaaacatagcctacaatgtggaagagattagaaaataaacagggaaatgaaaatgtttttattaattcgcatcagtatccatgaaaaatagtcagcataataaaagattataacactgaatgtaaaaaacaatccagcagttcagagtgataggcaaaagtttttaattgtatagattcaaattaactttggacaaaagttaaaactcaggcagagaatttttttttcaacaacagacactaacaaaaacaaaggcacagtaaaaattgagacagaaaatttgcagtgtagaggtatgaatctaatgatagacacaggcatggatgattaataaatgataaaatgtttagaggatgatcactagaatacaggacatttatacttttaaaaaccactttcccaaatacttcattataagtaagttgtctctaaaagggacagatcttctagacccctccttaaccaagtaactagtcctgatgtcatgataatggtgatggacaaactagaccttctctgcgcgcagatgggctgaggttggaagctcacagcattgactctgcagtgttcctggcaaaacgtttaggctgaatttaatcatgaagacattttcaggcaacttcagaatatagatcattgaaccagacagctgacctgtcctctacaaacaagtccatatcaccacaatcaatgacaacaacaaaaagatgaggaaatatttggggttcaaaataactaaagaaatgtagctacattatctttttacgtttttttgaacccaaaatgtctcttctcctttttgttgagtgattcgtggtgacatggactgtgtgaaggagacaggtcagctgtcctgctcagtgctctacattatgcagttgtctggtgattaacctaatatgaaactcaggccaagcactttctgcaagaacatggcattgttcacattctgcaccggcagattccgaggtgacatgctgtctcctgccagtggctcctgactcctgttctctacaggataagaattgagaggagcatggctacagcctctcaatgctgtttgtccatctagatgtggtcttcctaagtattgatatcaattggaggctgaaggactgtagcttctgtcaccaaaggagcctagtgggttacaattgtcaagagcagtcagtggttctgaaatacaattctcagcgaaggatccctcctgggttacagatggatcagctaaaacaaaccaacactgaagatacaaagaatggggttaggttcactgaaactagggtaacacctttgcatgagctaaacacaaagatgacactgaccttgagcaggcatagaaggtcagagacatgcctgcaaaatgaaatccctgcggaactttgtagctacccagagatatgtggttcaatttagaatgtctgacagatcactcctggcatgtgctgcatagttatgtgaacgtgtcacacctaactttggtccaatgtcttcagacttagcacaggttgccactggcatggtctgagaataggaatagagccatgcccactgacccatcctatgcctgggcttcgaaatggaactatagtttcattcaaacctacatgtgcctataggtcctgcctgcagcaatgacatctctcagtttagtaagggctgcttagtgtgggaatatgactcccatctggaagaccaggtggagacttatcaccatcaaagtaaaaaacctattgtccacttcaagggcaaagctgctgtgctgttccttaaatgagtaaaaggcacttctgtagtgctggaatgagtcaggcagttcaaagtaagttggaggagtcgaataacatctatccagtgaatcctgcaagacttcaggctcttccacttccatcagcaccccgttgagcctgggaaaggagactaaactaaagaagtagccagggaaaatcagacaccacagagccccaactagatttccggggtaaaataaggaagtggttaaaaaagaaaaaggatagatccattaatgaggcaaaaaattattgcctttatgttgggatagaacagggccaggtagaaaacaatgaaagagaaagacagagagagagacagacagacagagagagagagaggagagaaagtgagctcagtgaattggccaggtgacacactgataaaggagtaaaaagacattttgagttagtgccctcatgacacacagcaaaagagtgagctcttcagttttccataaaacttgctcaaaattcgatgcagtcaccatgaaagtacagcttttgaggtacagtcaacccatggtacattagtaaatgataaggggaggaagaaatgaaaacctaaatgtctactacaatgaaaaccaacagcaatgtcagtaggagtgattcagccttcgttgaaaacatgaaattaaacacaccctgttttccctggatctgtcatctccaggtgttaacacagaattaagcatctacaattgctgaaagttacctggggcatggtgggttctgatcttcttccccttcttggtacttttcaatttctgaaataaattcagacatggacagacacaataagctgattcccctacacacataacaatccactgtctaatcctcaaacagggacctcaggctcctcagtataagaataggacactgtgggagatatatttcaggaggcctgaaggctgctcatgatagagattccttggtttttgtcccagaaactaagggtaaaatgtccctattctggtagattgttatcccaatatcatttgtcccaagtttgtgcaaatggttatgccatatttttccgatcaatttaaagcaaatgccctcaaatgatttctaggagaaaaactgcaataatcagccctgtttcatcaaatactcaggttgttcatggttgtgaggattttgactgaaaaaggaaaactacaaacccttgagtcgaaatcatagttctctgaatttgtcacatctgcccaggtccaatgtcttgagagtagaatctgagtgccacaggcatggcctgagatgaggaagagagccacgctcactgacccatctcatgtctgggcttccaggtagaactagagtttcattcaacctatgtgcctataggtcctcactgcagcaatgacatctctcagctcagcaaaggccaattggagcaggaatatgatctctatatggaagactcagtggatccttattgccttcatagaaagatactcaccatccacatcaagagaaaagccaacgtgttgttcctccaatgaggaaaaggaacttccatagggctggcatgagtcaggcagttcaagataactggaaggagtcaaataacatctatccagtgagtcctgcaaaacttcagactctactacctccagcagctctctgctgcgcctgcaaaagtagaaaaagtaaaggataagccaggggaaatcagacacaacacagccccaactagatgtcatgggtagcataaggaagtggttaaaaaagaaaaaggatagatccattaatgaggtaacaaattattgccttcatgttgggtcagaacagggccaaatggaaaagaatgaaagagaaagacagacagagagatagacacagagaaagagagagagagagctcagtgaattgtccaggtgacacactgatgagggagtaacaggacactctgagttagtgccctcagaacacacagcatacagtgatcatgaaaagactgtgctcaataattttccataaaatgtgatcaagattccatgcagttgccataagaatacaacttttgaagtctggtcaacctacagtaggttagtaaatgataaggggaggaagaaatggaaacttaaacatctactgtaatgaaaaccaacagcaatgtcagtaggagtaattcaaccttcgttgaaaacatgaaatcgaacacactcttgttttccctggacctgtcgtctccgggtgtcaacacagaattaagcatctataattgctcaaagttacctggggcatgatgggttttggtcttcttctacttcttggtacttttcaatttctgtaataagttcagatatggacagacacattaagctgattcccctacacacataacaatccactgtctaatcctcacacagggacctcaggctcctcagcatgagaataggacactgtgagagatattcttcaggaggtccgaaggctgatcatgatagagattccttggcttttgtcccagaaactgtgggtaaaatgtccctattctggtagattgttatcccaatgtcatttgtcccaagtttgtgcaaatgattatgccgtatttttccaatcaatttaaagcaaatgcccccaactggtttctaggagaaaaactgcactattcagccctgtctcatcaaatattcagattgttcatggttgtgaggatattagacactgaaattagagtgaaggaggaaatctacaaaactgagacaaaatcagagttgtgtgaatttgtcacatctgcccgaatccaatgtattgagagtaagatcagggtgccacaagcatggcctgagactacaaagagagccacgctcactgatccatcccgtgtctgggcttccaagtagaactagagtttcatttaaatctacatgtgcttataggtcctccctgtggcaatgatatctctcagctcagtaatggccactagcagcaggaatatgaccctatccagaagactcagtggatccttatcaccttcatagaaaggtactcaccacccacatcaagagccaagctaacatgctgttgctccaatgagtaaaatgcacttctgtagggctggcatgagtcaggcagttcaagataactagaaggagtcaaatatctatccagtgagtcctgcaagacttcaggctcttccccttccagcagctccctgctgagcctagaagagtagaaaaagtaaagaataagccagggaaaatcagaaacctcagagccccagctagatttcatgggtagcataaggaagtggttaaaaaagaaaaaggatagatccattaatgaggtaacaaactattgccttcatgttgggactgaacagggccaaatggaaaaggatgaaagagaaagacagtcagagagagagagagacagctcaatgaattgtccaggtgacacactgatgagggagtaacagaacactctgagttagtgtcctcaggacacacagcatacagtgatcatgaaaagaatgcgctcaataattttccataaaatgtactcaactttccatgcagtcaccatgagaatacagcttttgaaatatggtcgatgtaccgtaggttcataaatgataaggggaggaagaaatggaaacctaaatatctactgcaatgaaaacaaacagcaatgttagtaggaataattcaggcttggttgaaagatgtaatcgatattgtcagcccactctgttttccctgaaccaagagtctccaggtgtcaacacagaagtagctgttcacaattgttcaaagttacctagggcatgatgggccttggtcttcttcctcttcttggtcctttttaattcctacaataaattcagacagggacagacaaaataagccaattcacctacacccataacagtccactgtctaatccccacatgaggacttcaggctcctcagcatgagaacaggacaatgagagagatatacttcaggaggcctgaaagcaggtcatgatagagattctttagttgcatctcagaaccaagggtgaaataccactattctggtagatcgttatcctaaaatcatttatcccaagattgtggaaacagttatgccttattgttcccatcaattcaaagaaaatgccccagatgatttctaggaggaagactgcagtattcagccctgtctcctcaaatgcccagctcgttcatggttgcaagatactgaaactagaatgaaggaggaaatctacaaacccttgagtccaaataatagttctgtgaatttttcacatctgcctgggtccaatgtgctgagagtgggctgaggtggtcacaggcatggctggagactaggaatagagccatgctcactgacccatttcatgtctgggcttccaactgaaactacagtctcattacaagctatatgcacccacaggtcctgcctgtggcaatgacacctctcgggtcagtaagggccacttggaacaggaatatcacccctatctggaagaccaggtggaggcttatcactttcatagtaaggtactcactatccacatcaagagccaagccaaggtgctgttcctccaatgagtaaaaggcacttatgtagagctggcatgagtcagacagttcaagataaccagaaggagttgaataacatctatccagtgagtcccgcaagacttcaggctccttcttgtccagcagctccctgctgagcctggaaaagtaggaaaaagtaaagaataaggcaggggaaatcagaaaccacacagccccagctagatttcatgggtaacataaggaagtgttttaaaagaaaaagaacggatccagtaatgaggtaacaaattattgcctttatgttgggatagaccagggtcaggtataaacggatgaaagaggaagagagagacacacacacacgcacacacatgcacacacacacgcacacacagagacagagagatagtgagctcagtgaattggccaggtgacacactgatgagggaatcaaaggacactctgtatttgtgctgtcaggacacacagcaaacagtgatcatgaaaagagtggtcttaataactttgcacaaaatgtgctcaagtttccctgcagtcactatgagaatacagcttttgaggtatggtcaaccttcactaggttagtaaatgataaggtaggaagaaatgaaaacctaaacatttaatgtaatgagaaccaaaagcaatgttagtaggcataattcagacttgtctgacaagatgaaatcattattttcagcatgtactcttttccctggacttggcgtctccaggtgtcaacaccaaattaactgtccacaatttctcagactcatctgggatctgttgcctcttggtcctcctttttcacttgatcacatcgatgtcctgcatgcaaataaattcaaatggggcctcttacattaagcagttcttccttgcacacagaaaccttcctctgtccaatccgaacacagggacatcagtcttctcagtgtgagaacaggagactttgagagaagtataccaggaggcctgaggttaagtcttgagagaactgacttggttcctttcttgagctttcggcaaaattcccctgttttggaacgttatcttcccaatatgctctgtcctaggtttgtgtacacaaatgagcaatatttctcccaatagagtttaagcaaatagttctaacaccttgtaggagagatactgcaatattcaggcttctctcataaaatacccaggatttgatagcttacgagattgtggacactgagatttgatggaggggtgcaatgtaccagctcttgagtcaaaatgagacttggttcgacacggaagcatcagctactatggcttttttgggtaaaaagtcagccatttatctagaaaacatgccagcaagatgatggacagatgagctaaaacaagccaacttagaagacacagaaaatggggataaattcagtgaaacctgggtcacattttccactgagaggtagacaagggtaatactggccttaggcaggtaaagaactgcacagacatgctttgggaacaaaactcataacgaacttcgtagctggcaagagacatttaattcagatgagctgatctgacagacaactcctgggcatgtgctgcatagcttggtgtgagtttgccacaccagccttgagttcaatgtcctgacagttgaaccagcgtgccacgggcatggcctgagactaggagaaagccaagctcactgacccaccccatgcctgtgcttcagactcgactccagagtgattgaaatctacattgatatataggttcagcccacagtgatggcaactctcagcccaaccaggggcacaaggcccggagattatggggtctacctgggacacgaacgggagctttatcaccttcacaatggagtattcactgcctatgacaagagccaagccgacttgctgttcctctaatgagtgaaaggtgctcctgtaagactggtacgaggctgacttgtcaggaggaattgagagagtcgaataaccttcatcccaggactcctgaggggcttcctcctcttcagactcctgcagattcctgacgaggcaggcaggacagggatgacagaagatttaaccaacagagattagacaacaaaacctcccagatgttctgatgggagacagaatggagtggtcacagaaaccaaaggcatttttccttcaagagaaataaaattatccttctaaatgcaaggtagagggtgtctgctctggggacagagcaaaaatgggcagcacgtgctcagtacatttgccacagatgagccaatgtagggcaccaagactctccctgtaaactaccatcatgacttgcagcacagagaactaacactgggcttcaactactttgcataaattaaattgaattttacatgcagcattcaagtgaacagagctcttgaggcagtgcagacacagatcttgggtattaagggccccatttttccaatattttgatataatacgtttattttttcaatttcttttcttgcacaaatactagcaaacatactaacaaaaaatgggcagaaagcatatatacatctctccctggatttaaacacatgggagagaacaggcaacaccaagaaatccctgtttgagggtctagagtagactcccaggaaactccaacagacctgcagctgagggacctgactgttagaaggaaaactaacaaacagaaaggaatagtatcaacatcaacaaaaagaacacccacaccaaaaccccatctgtaggtcaccatcatcaaagaccaaaggtagataaaatgacaaagatctggagaaaccagagcagaaaagctgaaaattctaaaaaccagagcgccacttctcctccaaaggattgcagctccttgccagcaatggaacaaagcaggatggagaatgactttgactagtgacagaagtaggattcaaaaagtcagtaataacaaacctctctgagctaaaggaggatgtgcgaacgcattgcaaggtagttaaaaccttgaaaaaaaaattagacagatggctaactagaataaactgtgtagagaagaccttaaatgacttgatggagctggtcatcaaaccatagcatgagaactacgtgatgcatgcacaggatcggtagccaattcgatgaagtggaagaaagggcatcagtgattgaagatcaaattaatgaaatgaaatgagaagagaattttagagaaaaaaagagtaaaaagaaatgaacaaaacctccaagaaatatgggactatgtgaaaagaccaaatctatgtttgattggtatacctgaaagtgacagggagaatggaaccaagctggaaaacacttttcaggatattatccaggagaacttctccaacctagcaaggcaggccaacattcaaattcaggaaaaacagagaaaaccacaaagatactcctcgagaaaagcaactccaagacacataattgtcagattcaccaaagttgaaatgaaggaaaaaatgttaagggcagccagagagaaaggtcgggttacccacaaaggaagcccatcagactaacagcagatctcttggcagaaaccctacaagctagaagagagtaagaggccaatattcaacattcttaaagaaaagaattttcaacccagaatttcatatccagccaaaggaagcttcataagtgaaggagaaataaaatcctttacagacaagcaaatgctgagagattttgtcaccaccaggcctgccttacaagagctcctgaaggaagtactaaacatggaaaagaacaaccagtaccagccactgcaaaaacatgacaaattgtaaagaccatcaatgctaggaagaaagtgcatcaactaacaggcaaaataaccagctaacatcaaaatgacaggatcagattcacacataacaatattaacctgaaatgtaaatgggctaaatgccccaattaaaaaacacagactggcaaattggataaagagtcaagacccatcagtgtgctgtattcaggagacccatcgcatgtgcaaagacacacataggctgaaaataaaaggatggaggaagatctaccaagcaaatagaaagcaaagaaaagcaggggttgcaatcctagtctctgataaaacagactttaaaccaacaaagatcaaaagagacaaagaaggccattacataatggcaaagggatcaattcaacaagaagagctaactatcctaaatacatatgtacccaatacaggagcacccagattcataaagcgagttcttagagacctaaaaagagacttagactcccatacaatcataatgggagactttaacaccccactgtcaatattagacagatcaatgagacagaagcttaaaaaagatatccaggacttgaactcagctccgcaccaagcagacctaattgacacctacagaattctccaccccacatcaacagaatatacattcttctcagcacaacatcacacttattccaaaattgaccacatagatggaagtaaagcactcttcagcaaatgtaaaagaatagaaatcataacaaactgtctctcagaccacagtgcaatcaaattagaactcaggattaagaaactcactcaaaactgtgcaactacatggaaactgaacaatcagctcctgaatgactactgggtaaataacgaaatgaaggtggaaacaaagatgttctttgaaaccaatgagaacaaagacacaacgtatcagaatctctgggacacatttaaagcagtgtgtagagggaaatgtatcgcactaaatgcccataagagaaagcaggaaagatctaaaatcgacaccctaacatcacaattaaaagaactagagaagcaagggcaaacaaattcaaaaactagcagaagacaagaaataactaagatcagagcagaactgaaggtgatagaggcacaaaaaacccttcaaaaaaatcagtgaatccaggagcttgttttgtgaaaagatcagcaagaaattcctgtttagctagttcacctggctcatctgattgcaagttcctatcttgacaggactacaaaattaaaaccaatacaagggccacaaataatgcacaacattgttaataaggacaatttgtagttgggtgaaaagaagaaatagttctatacatcacttcccctttttccctaaatctacaatctcctggtgtcactattgaattaacagcccacaattccatagcattacctgggaaacactggccctttttcttcctcttcctcttcctcatcatcactttcattttctgtaaataaattcagagaagcaggtcacattaagcaattcacacttcacatatgaccaaatcagtgttcagtcatagcacaaggacataactattctcagtgcaagaatatggattctgataggaatattctagggtgccctagattaagtctgatgagaagtagatgaccctgctttccagacccacaggccaaaatctccctctatgagtagaccataatgccatattccctgcctgagtctatgcaaagttaaacaaaatttttcccaaaaaaatctccaaaaattgctcaaacaattttctaggagtgttgctgcaatactgacttatatccccaggtaacacggacattaaatgtttagaggcatctatacatgaaacttgactgatagataaatttgaacagctcttgctttaaaaaggatctgtgatttgggaggctgaggcaggtgaatcatttgaggtcatgagttcaagaccagcctggccaatatgggaaaaccccatctctactaaaaatacaaaaactagccatatgtggtggtgtgcacctgcggtcccagctactcaggaggctgaggcaggagaatcacttgaatctgggaggcggagtttgcaccaagccaagatggtgccactgcactccagcctgggtgacagagtaagactccaacgcaaaaaaaaaaaaaaaaataataataataataataatctatgatgctacaaagaaacattggatcagccattgcattgatggggtggagaaccagggtccagccttgctttatggaaatatatcagcaaagtaaagaagaaagtttccttcccgatttcaaggtgactgtgcaaagtagctaggtaagctgacttaaaggagatcgagattaaagctgagagcagtgaagcctggggaacaatatttccaaatacacaggaaaagctgccagcttcctttaaaaggcatagaaactccatggacattgtttagggacagatggcctaatcacaggggacaagagatactgagtcaaagctaggaggcctgacagatacttcctgtgcacctcctgcactcaggtgactatgagattgtcacacttgcttggggtccagtaacttgatactggggactggcagacaaaggcatgacatgagatgagaaggacacacaaactccctgatatctgtgtttagaatccaatcgtagttttttattcaaaccaatttgtgtatatagagcctgtcttcagagtttatcttcctcagcctagaaagaggtatgagacacaaggaaaatagaggctacctgggataatgtgtacagcatcctctcattcatcatgagaggatgagtcaatgagagttggatcgactttatcttcctcaaatgtgattttggtgttcctgtgaggctggttggagtcacaagggccgtggctatttgaacaagtgacggcacgttcctccagtgagtcctcagggacttccttttcttcagccttctgcacctccctgatgagccaggtgggatcgagatgacagaagattaaacacagagagattggaccccagggagtcctagctggttttgacaggaggcatgagagtggtcccagaaagcaaccaggaggttccctttaagagggaacaggcaatcctcttctctctgcaagagaacatggccgccaaaggagccagagaggaagagagcagctggtgttcattgcactggacagataggagctgaggtggatgaagactcagctatccctgtatggtacagacatgacacttggcacacatagagaaacacgacagatgccacactctgtgtctcagctgggttgaatttcacatactgtggccaagggaatgcaggcttttggcccactgtagatgccagagagggtgtgccttttaaacctttttcatgtgttaccacccattacttactcctgagtattcagtgttacctgggggcacatgattcctgtactttctcagcctcctcaacttcaacatctttatcctcatcttcatcattttctgtaaatacagaagtgtttgttcagctatttcccacttcacactctgcaagacagtcagcccaatgtacacagagacatgaacatctagtcatgggttaccgttaaactgaaagctctcatgttttgtctttaacaaaatgccctggaacggttttctgatccatcaggcaatgcatttctgatctggagggccaccatcaagatgtggccaaatactgaaaagactttttgctccccatatcactggaggcttgtgcagcctctctctggactttggcaactgtctcccccatcccatcacagatctgattcccaggcacaggcttggtgtcttgtcacagttcgcattttgaacctaattctttctcttaggagaggacaagcttgtcccacagtgctctatgaatcaggagacttcacaggccctccatgtggcttctgctgtgtgacattctctccatggggagtgctccagtctgaagcacttcttaccaccaaaagcccctacatcaagtgccttctccaacatgacaaggcgaggagcttcatctcattttgaaaagcagtagtaagtgttcccacatttggatacttcagtcccttgcaagaaacaatctgtctgcctttgcagatggtgagagacaaactcaggaaggataaatcactcacttaccgacagttactaagaacattgctgaagaaacagcatgggaaccttcattcttagtccagagctcttttcactctaacaagcgccctccagtcacagcctccttcctgtcctttaaaactagacagatgctgcctcttgctccaaagatcaccttccatcaaggaagaagggacacttgcaatactgtgacctccaaccccatgggtttcccatctctgttcttacccaggaagtcctggtcatgtcatggccacatatgtttagtggaaaaaaacaccaccgatacaactgtcattgaaagtatggaggtctggagtctctcataagcctggggttttgggtcatcagggcctacggtcaccttacctgggctgagcttttggacaaggtgctgtgccagcctacacccctcagccagctgttcttggaggtcctgcccctaggacttgtcccactcatccagagtgaggagggcctggagatgctgattcaatgagtgggaggcatctctcccttcctgtaacttctcctgtaactgggtcagctctcattcctgagagtggactgggactttatatcacctaaggttagatagtagagaaaatttaacagtggaactggatgagtgatcagttctaatattatgacagatttctgagagaatgtcctcaaggagacctccacgcagaaggtcaacatacgtttaaagaaatgtctgtggccaagaaaaagaataaaaaatggtttacaggcttcctctatatcagagagggctcctgtaagatcctcgatgatgttccattcatctttctcttctgtaaacaaaagtaggtgtcttcctaattcagtttcaaaacaacatcccttcagttcctcactctgaccagggaaatctccatgtgaaaatacacatagtgcatcttgcggcgactagatacaaagccatgtacagaaatgaggccaggtgaagatggggagaattgaaaagacaaaagaagtaaagaatgacagggtcgagaaggcaacattgattgagtgaaagaatgagaagcagcagtcaggaggtgattctcacttagggtaagtagggaggtgatggcacaccattttgagtatactgaatgctgctgggttgttcccactcctttggttaattttgtgttattcaaatttcacctcaacaattacttgtttgaaaaagagaaaacaaggctctgagaaacaactgcaacccataatttattattatccttgttctctgtttgataaatatttgtgtgtcaagagccctaccatggcaattcctgcctttcccctggcccagcttagctcttacttctccccaccgagctgctgtacttcagagcctgcctgccccatggggcctgcctgcccccacttgcctgcccccacggggacccctcacctgagctcctcagcttgcctgagctgctctgcaagcttctccttgaactgcagctcattcctcagcaaagattttatgaggtctttgcactcttcacactctgagaaaagacagacacgcctgcctcagtggaaggctggacatgctgctgtggtcactgcccacagggcaggagccaggtccatcccaaggacaaaactgtccccagtaccaggccctaggaagggatttccacatctttattcttcagtctcctgactttctggcatctgatcctccaaaatttagggacgaagaaagagaaactcaagggcacatcaagaaagttgacaagatgattcaaccacaatgaagtggagtcagaattcacagcccctgaggtttgactctgaatgcggggccactttcccaagccttgcagcctctcctctaaaacactgcactggggcatgaagtagtgatttcttgtacagtcaggaaggccccccaggactatgggaatgatggtttcccttttactgggaatttcaaggacaaatatgtcaaagatttttaaatcatatcttcagatatgattttaagaatcatatctgaagcataaagtatgaggcataagaccataaggccatgaagggaatacgcccaaatgctaataaagtttgtgttaatttagaaacagtagaatgaagaagtaattgatagtgtttactctgtgccaataaatgttctaggagattggcaagaaatagctcatgtaattcattgcagcaatttacagaggtaggtattattgtcgtaccctgtgaacagatgaggaaactgaggaacagactgagggacagacaagacaagtaacttggatagagcccaggagacaggcctagggtccctgctctgcacgctgtacttctacttccacacattctcaggtgcgacctttcttcttctttgggagcaagagcctgtgcctcaggaagaaggacttccctctcaacagggtactctctacttttttttaattaattatttatttatttatttatttatttatttatttatttatttcgacgagtcttgccttgtcacccaggctcaagtgcaatggcgtgatcttggctcattgcaacctctgcctcctaggttcaaagaattctcctgcctcagcctcccgagtagcggggattacaggcgccgcaaccacgcccagctaatttttgaatttttagtagagacggggtttctccaacttgcctaggctagtctcaaactcctgacctcgtgatctgcccaagtcagcctccgaaagtgctgggattacaggagtgagccacagtgcatggcccctactccctgctcttgatgctgtcacttatatataccacatgttctattaggagcagactgctcttgaagcccttcagagcgggtactgggtactatcaccaagtttccctcagggtcactagaacagagctttgcctattgggcctcaacagaagcttgaactgaataaaagttcacttgtccagacatttagaacaacagactagatgttatttgtctgcaggatcttatatagtacagagaggattcttgaaaacatgatttagcctcttggagaaaacaggtcattctgtgcctgtgtcagaaatcaataactgggattttaactctagtcccacccccagctgactgctaacatggaaagttgctaaatactttggtacctctgtcttccaaatttaacaaaatgttaaaatacccatttctattttcttagatgtacgggaaggatgaaattatttttgttggagacagcatttagtttctcagagagaagatagggcattattcatcacttttgtgatggtgagcctatagaacttatggtatttgttctgccggttggccaggagtaggccacttgagttacaagaaatttctctttgatgattctgaactgctgtttgttctctgccagctgggggcgcaatttctcattgatttctagaatgttcttttctgccttctcactggatcaagggctggcagacaacaccatgctgacgtttgtggcagaagaggtggagccagggactggggagaagaaacccaaacacatgatgggttaaaaactggtgaaatccaataggtttaatcaggactgagggatgtcagtaactgaaattcttaacttactattgagaaaaatgtgatcactccccacagcactttaggatccttcaccacaaaaacaaggtttgaggtgcctgaactcagagctgaaggcactcactaccagtagctcagactctgacaaaagtaaggaagattgtggccagcgtgccaggtaaccgtctgcagttgcaataacagaattagaagataggggtgtcatggaatcttaggagctctgcgttgcaattgcccaggctttgctgaaactcaggcaccctggtctcacctgagggtcaccaccaatgaagattattccttcagcattcactctcagtattcgtgtacccctgtgacaatgccacagacccatctctttcccaatacatctaagcatattcctcactgtttatctcttgtctgtacaacatcatcaaggcaaacagtttcccaacaggttatattttcttaatcgtagtcatgaagtcaccccacctgctctaagttaaaacagaacttaaggcttttccacaagtctaaggtatcaaacttttagcttgccctgatgtcctctgggtcttctgcagttttttctgtatccactagaaagtgaatgaataatccattttttaaaaatgttttctttcctgtctcggtattcttcttgctgcatcccattgttatgttgattcctttttttcttactggggcaccatcttggcttttcattacactctagacaagtatgacatccctacatccaaaactcttcctctgtgtggggtgatttgttttttaatgtcactgaacactacattttatacttgtcacttatggatgtcattctagtgctacaagagctcttttcaaggtatcaagtgatcaaaatcatttacatagggatctcctgaaaacatgtgtgaccatctatcttgggaatttttgtaaactgatgctattttgttgtttccattttgttttcccatatactgaaaagaacaggaccacgagcagttcttatggaatatggtttgatatattttgttgagttggactaataccattgatttttggttgcattccactaacagaacatgacaagatcaaggttatggtcagggttgcttgctgatcctcactgttgctgtgcagtagaaggtgagtttgaggtgaaaggcgtgagtaggaaagagtgatcccctgaaccacctcctcactttctcagctttcatcccacctaggttttgtgagcctggaacttgggagaatgttctgtagcccaggtctcctaagattggctgctagacttgcctgagttgaggatgcagtgggtgtgaacctgggctgcccagcattcatgtggaagtgaaggaaggaggactggatcaatcccatttgaaagcatccctccctgcagcccgcaccatcctccaatgacactatgaggacactgctttgagatgtatcaaaggctttaagtcaatgtattttctggggtctgggagacctgacattctgtttcagaatgaaaatctgtcaggtttattcattttacaaatgataaaactgcaagttcacaaagttacatggcttacatgaggtcacacaaagatgagttttcagcactgccaataaaagcaatcacaataattattcagtaattattcatagaatccatataattcgtaaacattcacataattatttagtaattattcattgaccaattcatacaaggcattttgctcaaaactgtgctcatatttggacattgtatcttcatcataatccttaaggtaacgctattatccgtaagtaacaggtaagaaacctgaagaagaggaatagcaaatcatgtatttggccatatttccattttttggtttttgtgatgctggaagaatgaccagaatgagtcacgggaagaatattcattcctgtattattctccaggacagaggtgtgctctcctagagtactggggccaaaattcagaagtgtccgcaaccttgctttaacagtatgggaaataacctctatcacctggaatttccctggaactttggaatatacaagagaagtatgagatttgggtcttcctttggctgtgtttaattcactcttctatggaataccaatgattctcactaagacttctgcctttttataaccacaatgtatgttatggagaagattttatactttgctctatttagaaagaataaatatgagcaatggtttaggttttaggtcctggacttaatatttttctgatttctgttttgagattaaattctcatgtaaatagaaaaatacttattatttcttataaggccaagtttgttattagtttgagttttcaaaaatgaagcacaaacttttgattttatctttgtctgtccccatcagcgccactcattgtctatcagtatgacctggacttgcccctgcacttaacctcatcctgctgagccatctccaagcactgtccaattccgtcagtgattctggctcctcccaaggctccctgaaatggatgcagggatcaggacatcagacacattccagacacaaaggcaacccagactgtagagcaggcagctgtgttcccactaccctaatgttccagtgatgtcctaaaactgaaaggaacactttccctttttaggggtctgttcttcatgtctcaatgcctctggtctagttaacacaactgttctgtaagtgaaagaacttgctaaatttctggtttcttgttaggtggctagaataggtttataagacttccttacttacccatgactgctgaagtttgaattcttaacagtatgattctttttcttgtaagatgagcagtttaggaaagataggccatgttgctgtgcaaaaagaggtaaacttaatttctactcaaagcatgcttgaatttgaagctagggcttccattcttccaaagttggactgtcactgcctcaggcatgtgttccgaagggcttgtgtctctgctgtactcaaaataaagtttaaatggagcccagcaagccagatctcctttagttctaggttcccacaacagtttctcctctgctttagagactgcattgaaaatattcttgttctgctgttgtgttttggctttggaatgatgtgatgcagctcagtgggtcctacccccaagttgatcagagtaagaaacacctgggaaagtcagtgcaaatacaagttcattgtcctccttgcagggatttggaatcagagggctcaggtgaggcctggaatgtgtctgttaacatgactcagatgtgcagtcaatttggggacccactgatagcatcgaccttacagtttatgggatgattctttctgttttgctgatgaaaaaactgaggcacagagagtctgtaactttcccaagttccccttgctgtaagtcctggagccagatatcaggtggagcagcctcttccccatcaccttcccacattttcagctgggtcagttctttccaagtacgtgtttctctcccctatacctcatttctgaaaaaaggaaaacttctagaatgtaacttctttcatctaatacatttcctcaaaacttgctgccagcatcatattctggccacttattattaaagtgagatgccttttttttttttttttttttttttgagacagggtcttgctctgtcgtccaggttggagttggtgattatagatcactgcaacctcgaactcctgggctcaagcgatcctcctgcctcagctttccaagtagttggaactctaggcacacatcaccatttctggctaattttttatttttcatagagacaaggtcttgctatgttgctcaggctggttttgaacttctggcctcaagtgatcctcccacctaggcctccaaaagtgctgggattacaggagtgagtcaccaagcctggcccctgaaatgcttttttttttaatttttttttttaatgaaaatacaggacatggagatgtggaaagacaccttgctttattactgttgttattattattatttctacagtataattcatatatcacaaaattcaccatttttaagcatacatttcagtgtcttttaccatatttcaaagtctcacaaccatcaccactacctaattccagaatattttcataatgccaaaagcatgcctgtatgggcagtcactctccaattccccccttcttgcggtctcagacaaccactaatctactttttcaatatacagatgcacttgttctgggcacttcttctatatggaataacaaagtgtggcattttgcatctggttcttagcatattgttctcaagtttttttagcctgcattagtactttaacttttttatggccaaataatattccactatatggttatacgacattttgtttattcatcaactgatagtgctttaagatgtttccactttttaactcttatgaataatgctgccatcaacacctttgtacatgtttttgagggaacacctgtttttcattttcttggttgtaaacctaggagtgcaattgctacatcatatgtcactttatgtttaacttattttatgtttaactttttgaggaactcacacactgtttaccaacttcagtagctatgccattttacattcccaatagtaacatatgagaattccatattctccataactttccaaacatgtgttttctttatttttttcctaagtcatactagtaggtgtgaagtggtatctcattttggtttaaaattacattttcctaatgaaaaacgttgaacatctttgcacgtgcttcttggccatttgtgtgtttcctttagagaaacctctactcacagcttttttcccattgttaaatttggttgtcatttattgctcagttatatgaatttcttatatactctaggtactagacccgtgttaaatacataatttggaaatagttctcccattctgtggattatcttttcacttccttgacagtgtcctttgaagcatataagatttttattttaatgaagtccattcatctatttttgggttgtttgtgcctacttaaaaaatgtctaatccaaagtcacaaagatttgtacctatgttttcttacaagacatcatttttagaatgagaaatttccttggttttagtggagggcagacattgtttatgcctcctgtccattaccgatgtttctcctgattgttattcatatgctcaccacccctccatggagcatcccacggcctgtaacagagctctggggactgatatccttccactgactttggagctggtgagagccctggtcatgtgattcagcttagccttaacccgacccagttgcacatattcctcagggccttcagagttgaagtcgagaggctctctgagaacgcttgccagcccatgctgttttaaggctggagcaaacttcctccatctattccagacagaggggactgcaggggtaggagtcagtcaagacatctctggtgttagaaagtagagctgtttcagggtttggggaagattgttcaattaaactaagtcctctttgtttttactgtatgtgtgacttctttctacaaacaaaggaagaatatttatgttagaacattttatctattctttatcaattgtttgtctacaattttaacgtggataaaggagagctcagtgtaaatatattcttaaaaactaattatggttcatgtccactaccatgcgatcatatttaaatctatgaactatcctgttacttaggtattatcctgctcctgatgagaaaacaaactcagaaagattgcaaaatttccctaggtcacaaaaccagtgaggagaggaataagaattagaaaccagttccttttggccttcaaagctaaccatataccattagatcaaactgatttacatacttttgctggaattagtctcagagttcatggttctcgcttgattttcccaaggaaactgtgccactttaatatcatttcaaactttgaaatttaaactcttttttattatacttttttgtctttgttctgttccatttcttttgatttcttctcaacgaatccctcttatttatatgctaaatatttgttacctattttctgtcaattttcacatttttgagtgtttgttttctctctgttgtatgctaacagttcttcattgagatacaatttgcatagagaatactgcaaaaaacctaaaggtacagctttataaattttaatataattatacattgtataataacacccagttaaagacagagaacattttcccccatgccacaaggctcttatgtggtccttgccagtcaatactcatcccccaaatgaagaatatattctgaatgttgtcactgccttagtccctttgtgttgctggaaaggaacaccagtggctgggtaatttataaagaaaagaggtacatttttcccatggctctacaggctgcacaagaagcatggaacctgcatctgctcctgatgagggcctgaggctgcttccacttgcagcaggtgaaaaggaaccagtgtgtgcagagatcatatggtgagagaggaagcaaaagaaagtgaataaggtgagaggcactttttaataaccagctcctacaggaactaagagagtgagaattcactcactaccttctcccagggtggggattaatctattcatgagggatccactcccgtgacctaaacacctcccattaacccccacctccaacactggggaccacatttaaacatgtgatttggaagggaccaatatttaaactatagaagccgccagagattaattttgcttattcatgtgcttcatgaaaatgaatcattttggccagtcctggtggttcacgcctgtaatcccaagactgcgaggctgaggcgggcggatcacctgaggtcaggagttcaagaccagcatggccaacatggcaaaaccctgtctctactgaaaatacaaaaattagccaggcgtggtggcaggtatctttaatccctgctacttgggaggctgaggcagggaaagtttgttgaacctgggaggcggagccaagatcgtgacactgcactccagcctgggggacagagtgagactccatctcaaaaaaattaaaaaatggaatcgttgagtatgttctcttgttctgacttctcttactcaggtggttttgtatgccactagtttgtttgattgtgtttttccctcgtttcattttgttttggccaagtaatatcctattgattgtatgattgtcacacaatttgatatccatttttctgatgggagacaggtttacttgttggctgctgtgcataagtaactatgaatattctcatacaattatttctgtgaagatacatacttattttccagggtatctatagctagggatagagttgcttggtgaatgtgtagaaaatgggcacagagttttgcaaagtaattgtattattttacatttctatgaaagatgtaggccatttcccattgctctacattcccacacacttaatattttcagccttttatatatagccattctacaattgtgtagtgatatcctgttttggttttctcaggcctaatgttcatttagatatcttcttatggaaaatatcttctcaaatttttatgttcgttgatatactggggtgtttgtcattttctttgtaatctatagccattctttatatattttgaatgagtccatttatatatacatttttttttttttgctatattacattgcaaataattattcctggtctacagatagcttttaagttgttaatcaacaacataataagtagaaggtttttaaaaatgaagtgcaattcacttgatttcttattgtggtgagtgctacagtatctagtctaagaaatattttcctatgtcaagttcatgaaactatttcctatttttcctttacaggatttctaattttaactttcacatcttaagttaatttcaatgtatgatggagaatggttgttaatattaactttttaaaacaacaaatattatttcactcaaaaccattttacttaaaagtctttcatttccccaatgaaaggcattggtgtctttgtttttaaaacatttagaagtggcagtgcgagcatgttctcactcatgagtgggaattgaacaatgagaacactcggacacagggcggggaacatcacacaccagggcctgtcatgggatgtggggctgggggagggatagcattaggagaaatacttaatgtaaatgatgagttaatgggtgcagcaaactaacatggcaaatgtacacctatgtaacaaacctgcacgttgtgcacatgtaccctagaacttaaagtataataaataaatgaataaatatatatatttttttaaaagagtggcagtgcgagggctgctgcacagctagcagagccgtggtgaggacggcagcgcctgtcccgagctctccgcctcccctgcccgccagcccaggcggccccagcagcagtgaccagaggagcccctgcagcaacgcaatggccaggtggatgcctccatctacagccctgtggcggatgggacctgttaggacatcaccatcatgggcaacaaggacttgaactgggctgccatctcagggaaaaccttcgccaacatcaccccagctgaggttggtgtcctgtttggcaaagacttgtcaagctttttcgtgaatgggctgacacttgggggccagaaatatactgttgtcccggactcactgctgcaggatggggaattgaccgtggatcatcatatgaagagcatcagtggagccccaccttcagtgtcactatcaccatgactgccaagacgccaggcctgctgatgggcaaagaaggagtccacggtagtttcaccatttcataacaaaggaatgttatgaaatggcctcccaccttcagcgttcccaatactgacctcctttgttccttcccctccactgcttcccacagctttgccccactttccttctcatacatacaccattttaatttcagggaccattactccacacaccttattgctgccaaaacaacatgggctgggggccagggatagatggacagacaccttcccctacctatacccctcttgtgtgtggttggaaaacttttttcttttgaggaattttttaggaataaaaaagattctactaaaaaaataaataactatacatatgtttgaatgtatagtttgaatctgtattcttttcctttgatatatttatgaatacttacaacagtactaccatttttaaattactttaaaatcaggtttgaaatctagcagagaaagtgctccaacatattgcttctttaagaccaacttgcctattataggttctttgattttcaaatacattttgaaattagcttttaaatttctctaaaatctcctactagaaatattaatcagaattgtgttgatgtaatatgctaacaaaattgagtcttccaatcaatgaacatgatatccatttctctatttagtcttctttaatttttctaaccaattgcttttaggggccttgtgcctgcttcattgcatgtattcttaagcatggaatgattccggctattaatctctattatgttttattgaatttcattttctagctgctaattgctagtatggagaaattaagatgatgaaatcaactttataaaggtttaatttaggtacaacagactgcaccactttaaaatgcataattcaatgcatgtttacaaacgtatacactaatggaactactgccacaaccaagatagaggaatttatgccccaaagtttcttgtacccctttgcagttcatcagtctttcaaccctcgtgcccaaggaaccgctgtcacttcaggtccgtttccatttttaaccattttctataaatgaaataatacctgcgttcttttgtatctgccttctttcatgcatcaacgtaattttaaaatccatccagatgagtattttcatcaatagttaatgccttgtaattgctgagtagtattccttcatgtggctataccatgtatgtttgtactttcacttgttattggacatttctatcattccatgtttgggctattatgaagaaactatcatgagcatccatacgtggcaggccaggtctcactaacacaggcctccctaacaattatttccgtaccgactgagtggttcagttaaatattaagaggaaggagaaaaaaaaaccagtgcccttatacaaaggctggaatgtaacaaaagcccaccaagagttttgcctaggcttttcctggaccttaaagcatgacaaaataatgagggcattcttaacaggagtcgtttagtatgaaacaagttttattgggggtctgaagaaactccccaggcctccagaaacaagtttattggaggtctgaagaaactccccaaacctctgtgatttagcaggagacaagataagggtccccagcacctagacccatttagattaagtgaatttactgaggctccagaggaaggtcttcaggactcagaccttagttatagattaaaataggttaatcacttatgtatttacaggaatgcacacttccacatgcacatatagcttagaaggtatataagctcaggaaaactttgtaattttgagttggtctggtgataatttccaggccttttccctgtaaccagttgcagaagtaaaaattctcttcctccccagttcatcagcatcttgttactgacacacaagaaatagcagcccgcccctcagtttggtctggaaacagacatacagatcattgtgcagacacagcgtgtaaattcctaggaatggaatgactgtccatctcattggtacatgtttaacctttaagaaactgttagattttcagtcataccatttttcattcttacaagtataaaacttccaagtgctttaatcctcaccaatatgtgctattttcagcatttttaattttagccattctcatggatatgtactggtatctcattgttgtattgattgatctccctgatgactaaacagtagagcatctttttctatgttaattgaccattcatgtatcttcttttctgaagtatctattcaagtcttttgagaaattatttcattgtgctgtttatcttatcagactgcaatatatatagtatatatgtatagcatatatatactatatatatagtgtatatatatagtatatatatagtgtatatatagtatatatatagtgtatatatatagtatatatatagtgtatatatatagtatatatatatagtgtatatatagtatatatatagtgtatatatagtatatatatagtgtatatatatagtatatatatagtgtatatatatagtatatatatagtgtatatatatagtaaatatatgtgtgtgtgtatattatatatatacacttttaaaaaacctttgttggagatatatatatctcctatattgtggcttctttttatgttctcttaatgttccctattaggagaacaatagataatcttcaaaaaggtgaatatatatatatatacacacacatatatgtgtgagtgtgtgtgggtgggtgggtgggtatgtacacatatatatatgtcctaagaatcattaattagacatatatgtgagtatctatttctggattctctcttctcttccactggtatatattgtattttttttttcaacaaaacacatgatcttgattttcatagctgtagagtaattctggaaataggtagtgaattcattcaccattattcttttataatattgctcttttattactcttgatcattgacattaccatataaatgctagaatcagcttgtaaatttctaccaaaatgctgcttggaatttttactagaattgcattggatctggagatcaattcatgaagaactgactttttaaacataacaactcttctgatccatgacaaggcttatctccccactaatttagttctttcataatttctcaaagcaatttttttgtagtttttggtgtactggccttacatagattttgttgactttcttttttcttttttttttttttgagacagaatctcactctgttacccaagctggagtgcagtgatgtgatcttggttcactgtaacctctgtctcccaggttcaagtgatcctcctacctcagcctcccaagtagctgggactacaggcacatgccaccatgcccagctaattttttgtagttttagtagagacagggtttcactgtgttaggcatgatggtctcaatctcctgacctcatgatctgcccacctcggcttcccaaagtgctgagattacaggtgtgagccaccacacccagcctgttgaatttatttataaccacaacatgtatttagatgttactttaaatgaaattgtatttttatttcattttccaaatgctcactgctaatatacagaaatacaaaagactacttatattgagcttatattttgcaacactaccaaactcactaattagttttggtagatttttgtagatttctaggattgttaacacatatagacattatccgtgaataaagacagcttcaattctttattttcaaccttttcaatacttttatttatttttcttactttattgcattgatttagagctctagtataatgctgaattgaaagagtaacaacagatattctacttttttctctgatttaatggaaaagcattcaatcttatgccatttaatataatgttacctgtgggtttttcaaatctgcccttaatggggttggaagtgttgccttccgttcttatcatgctgagagttttctggggtttgtttttataaatcatgaaaaaagttttcaattttgccaaatgcttttactgtgtatgatgaggcaatcatacagtttttctcttttgccctgataatatataaaattatactttttaaatataaaaaagatttcttgaatcaagctaggacagtttttttaattataaacttttaacaaatatattgaaatataacttacatgcaattgagatgcattaaagtgtgtaatcactaaagtgtataattaaagtgtataattttaagagtttgagcacagtatgcatgagccaaagagaaaggacagaaaatactaagtatgtctcagcatatgtggtctatcttggtgaatgttctatgtgagtttgagaagagttatttgttagctgttcttagatgtattttgcttaaatgtcgacttggctaacttgtgtcattgattgtgtgaattaattttgttctagtgggcattaaaattactgtctgatcacattggacttatgtggacttggtttatgttttattacagtggattcatggaaagccaacagcatttcccaagactctctaatttggtaggactcaatcaccaatccacccctttgtggatggtgtcagggtttcgttttagcctttactagggctggtctagaataggccttattgtaaagggtgacacttattcctaaagcacagcctttccagtgtctcaattggatacctggatgctaatgaggtgtgcatgagttcttcccaccctggatggcaggaactccatcatccattccccaaccctcttccaccacaagtacttctggtccaaactcaactttatagcagccactcctatgttaaatctgttagtctttttcttgtgcaggtacagtccattccttgataagtatgcacatggaaccccacatggacttcgagagctgcccctctgaacagctgtctcctattggtgccctgccctgcagattggaatttcttcagtgaccttgaactctgatctctgccttctcagctcagtggggatgccctgctctgagaggactctagcctactgtgcagctgctgagaaattctccccagacaaaaactaggaaatcatggggcttccaccttaagtttcctgttgtactgcctgttgtccactgtctgaaaacaattttatgtttgtttatggaggcagtctgatatgacttattctaacagatagaagtagaaatctgttatagtcttttaattactgtgtctttatagtattatggtagacagaatcctaagatgagctgcagtgatctttgctcttatataatcacttcttcctgagtgtagacaaagccagcgatgagatatcactcctgtgattgtgttacaatttatggcaaaaaagttagcagatgtaatcgagatcccaaatcagtcgaatctaagacagagagattatcttatgagcttgacctaaagaaggtgaattccttggagggactgaggtcttcctggagaaatgtgaagtgcaggagggtttccaggcagggtgattctcctctgctggatggagaaagcatgcagtgggaacgtgggaggcctctaggagcagcaagaggcccctggctgacagccagcaagaaaacagagatctcagtcctgcagtcacaaggaactgaactcagctgacaacctgaggaaacttgagaggaagttcttccccagaccctccagaaagaaacccagcctagtttcagcctgtgaggccctgagaagaagacccagctaatccaggcctgaacttctgatctgtggacactgcaagaaagtaaatcattgttattgtaaccctctaaagcttgcagtaatttagtatgcagcaatagaaaattaataaaagtaaaatggagaagactttggagtggggacaagaatgaaatggtggtagagggatgcctgtatgctgagatggttgatgcctgtatggttgaattgggtctaccattcctcatctaattagctatggtctattaaggtgcatagctatacatgaatattggtactaggtgaatccagaggaataagatattgcattcttgagagtagatgagaacaccctgaattggtggtcaccgtatcatatgtcatatatcaggtccctctgggaaggccagaggaagatttacaggatacactagtgacaacattgaaggcttctttcttccccaaagggaaccaacctcccctcagtcaagacgttccaagtctctgaactggatgccaggttataaattcccactataccgactccatcaagcttctgtcctcagaactagagtttatcagtaaaagatagactcatgggagtctaggcatttattatcttattttatataaatcagctaatgtgcatgaacaaaacagactttgaagaaagaaagtcacagttaccacaggaaaacagcttcgacatcctcatgagtcgtcatgggtgttccattgggaggacttgatatgaggctttcctcctcatgggttagtacagatctgggggaaatgtcatcaagtactcgattcagagtgtagcagctgaggctgttgattcgttaggcctcctgcagctggagatgcaagtagtgcattttcagggccaccacatgtgcccttaggctagcattcttcagagccagaatccaaaaagccacagaagctctgagtatttccctttcctcggtcacccacataaatggcttcaggtccttctggggaaggcctggaggaagatttacagcatacacttgtggcagcattgaaggcttcactctttctcaagggatccaatctcctctctgtcaagaatctccaggtatctgaactggatgccaggtcataaattcctactatggtctctgtcctcagaactagagcttttctaattattacatacattgatttcttagtagatttcccatccattacattcccagacacctcacgatgattagtaatcaccacagatccctgcctctcaaggaaattcctcccaccttgtttctagatggccgcgtaccactgcctgtcctctactcttccagaaccctattgttctccctgacagcagggagggcaaatccatgcagcatctcccgccatgacctccagcctgcagaggagaggtgccacaggacctttacacgcatgccactgttcccctcacctgtgcatttcttaatgccttggcgaggagaatgtccctggatcttcattagtgggagctaaaggaacaaaggtaaataatgctatgggatccactgaaaattggggctgtggaaaagtggccactgaagtaagacagatgaagctattgtcagatactcagtgccagagcagggagggagaggaaagaaatacagacctcacctgcctctcacttccaggctccatcaggtgcccctcattgctaaacctaactagaagtgtgcatgcaggggagccagggatgcattttagaagggtaagccctgagtggcataagacaggatggaaatgagtggagagtggatctgtgggaagaaggaggggatgttattgggaaacaaaaggagaatactagctaataatgctaggtgacactaatattccaaagtctgtgctcatattcagaaaagaaagttcagcagaaagcactaaactaggagtcaagatattatattttcaactgttgttccaacagccatattataaaggaacagtttatttcatgcctttctaatttgacctaaagtgccaggtggcattggggctggcacagccttgctcaattatgtgttgaagagtacacagagactgccaggctgagggaagatgcaaaagaatagaagagacgctctcagggaacaagagaccacacggccccagagtcaggggcagcatcagccactgttggctgctcatttcccagacagagcccacaagcctcagccatgctttgcttctgcaagatgcttcttcaccttttcaataaacctgcctgaatttaagctgataggggtttatttctccttcatcataaatgaaatttttcaccacaacaatctccagtgaattgtgggcacagcaggcaggtgcatccctgcttctgttccactacctcccctgtaggttgaaaaggaggaggtactgaattacctccaaatgttcctctcgctctgatattctgtgattctggtttcttttcagctactttgtttttggaagcatgtatcctaaggcatccagctgaacaacctttgtctactgtgtccaggcattcctggtggtatttcagacaagactctctgggattgctgcactcacaaccactgaaacaattctatgaccatccatttcatggctacatgtttgctcattttgtgtgttcataaagggaggggacagacagcaaacttgcatgttacaaattgtatcatcttaaaaaggaaacaaggcaacactttgcaataaaaccttaagatgcattaaatttaagcctaatgcaataaagaatgcccataaaattcttatctaaagaatgcttagaaaattgttgaacaagggacatcatcatttaaagtgatatgaagaaaccttcttagctaagcatatgggctagattagagagaaaataaaggacccatctcttccctggaaaaactactgatagcatctttcaaaaagctctctgtgattgaggatgcaccttgatccataggctcacatttgattgcaaccggcagctacttcttggcattgacattgcattcccaactagtaaatccttccaagatctgagtttctgcagatatgatattattttttttgaccatccttatcttcaaaggctaccaaaaaggaacaaagattttatttacctccccaagggaaaaggttttaccaatgagacactttcttaccatgaccccagggccccctatgccctgttcacttgagtgccctgtgtggcctgacagaagctcatgctggtcacaggatttgttacataattaacctccttcctgaatcccaacttcatggtggtggtgatgacaggtgtcctgtatcccaggctcatgtccctgaagtcatcagcctgtctccagttagaaaaaattacatgtatatagcgaggtctctttggaagtagcaaaagctttctcaccttcatacattaatggttggaatgtacaatagtataaacactttgggaaaaaatgtctggcatattcttacagaactaaacaactacctattctatgactcagtaattcctaagcatttatccaagagaaattaaaacatatgcccagaaaatgatttatacaagaatgttcatagcagttttattcacaataggaaaaactggaaacattcaagtatctgtcaatacaagaatggatcaataaactttgacacattcattccatggaatggctaaaggaacaaactgttgacacacaaaacaacatggatgaatctcaaaaacattttgagtgcaacaggagccacacacaaaagagtgtgagaaaaaagataaacaataatggtttcaagaaatgcagagcagagagcccagaggcaaagacccacaggatggcaggtcagtcccaggctgtggatcctaattaagaaactcctgctggattttgtccagctccatttccaaactattttaggtcagtgacttctttatcccctccatgttccctcattttgaactagaatcactgtagttgttattctatgtctgtcccatcatttcaaatgaggggcagataagctgtttgttcagtttcacaggtcaaaggaggtaagggaattatgtcaaggatctgtactcagagaaggtaggagcttgagaaggactccatgagttattattggttgatgatggaaaagagaggtaaggaggaaagcaggtggcctctggagtcagagtgtctcccagctgacagtcagcaaagacaaagggccctcagtcccccagaaacaagaataggaaggccttcagtatctgtagtgaacttggaaaaatagcttgagctctagaaaaaaatacagccagcccattcctggattttagcctcacatgactctcatcagagaatccagctgcttcattccagacttctgtggtttcaaaccactggtttgtggtaatgtgataataggcagcaagagaaaactagtacaggtgcctgtctctcctcttgaatttcaattttagatacatggatgctaacccctctaagagaaaaaaattcaatcaataaatcaatcaatgaaagaactaccataaaaatattgccctcacctttatgtggctgttccagagcccttgccacctgaagaagacaatgagggctatttcaggcatgtgaagagtgtggctttactgttatcaatcacatttctgaaagaataaaaatggttcagttcaagccatggctcatgtctgtaatcctagcactttgggaggccaaggcaagtggatcacttgaggtctagagttagagaccaaattggccaattggagaaaccttgtctctacaaaaatacaaaaattaccccggtgtggtggcaggtgcctgtaatcccagctactcaagaggctgaggcaggagaatcacttgaacccaggaggtggaggttgcagtgagctgagatcgcgccattgtattccatcctgaggaacagagcaaaaactccatctcaaaataaataaatgaataaataaaaaataaagatggttcattacttaactccacatattattatatgaaaatgtatcacctcaattttaatagcagattttttaaaattccttttcttgtgctcaccagacaaggtttggtagcaaataccagtcaccagcacagatgaaccaattcaaggagagccataaacaggactaatattatgttcccccaaaaatcatccctagaatgcaatctcttctctacttgtcacaaaacgaacacaatagtccactatataaagtcccaaacacaggaaagtgtaaatataatgaaatctgctttccaaatgtttattctattcagacccagtcatggggaccagggattaggaaatgactacaaacaggttcaagggaatttgggaagtgacaaaatatgctgaagtagaactctgctgatggctgcacaattcgataaatcaacttacatcattgagttgtacattgacaatgggtgacttttataacaagtaattctttaaatgaacttttggatttctattccaacatggaaagagctaggcggtcatgacttgtcctcacagctagaaaaaagctgaaggaactgaaagtcaacccttctagggtagaccagagaattgaggtcacagggaaaactgccatctgaaaaatgagaaacacaggctaacacacaaggagtcacagctcacagggaagagaagctactggggacagcaagtgggaggagcacttaaatggtattgacagattactagaagctcagggtggcctggctagagcactgaaaactccttgaaaaccaactaagggggaatatcacacatttccaagttttactacaatgatctcaactaggttctcatgatgaagttcagaaaaactccctgaagtttggcactaccaacttcagggcttatattaagctacagtagcccaaatagggtgaagttggtgaaaagagaaaacacacacaaatagatccatggaaaagaatacagagcccagaaacagacctacacacagtccactgatcttccatgaaggtttagagacaatttaaaacagcaaagatagcctttccaactagtggtgctagaacagctggacaaccacatgcaaatgtatatagatagatagatccaggtgtgcatgttctaccctttataaaataaatcttacatgtaaatgtaaggtgcaaaaccataagaatcctaggagataacataggagaaaaatctcggggatcttgggttcgatgatggcttcttagatacaaaaccaaaagcacaatctactaatgaaaaaaaattaagttgagcctcattaaaattaaaaacttctgctctgtgaaagacactgttaagagaatggaaaaagcaagtcacagactggcagaaaatatttacaaaataatctgatggaaaaactgctgtccaaaatatatgaagaattctgagaactaaacaacacaaagcaaaaaaaaaaaaaaaaaaaagtaggtgaaagatctgaacacctcattcataagatatacagatggcaaataagcatatgaaaaagatgctcaaaatcatttgtcgtgagggaactgcacattaaaacagcaatgagatatcactgtaaacctattagaatggctaaaatgcaaaaaggtgaacacaccaaatgctgtcaaagatgaggagcaaccagaactctccatagctagtggaaatcaaaagagtacagtcactctggaaaagttaagttctctcaaaatcctgcacataagtacttagagcaattttattcataattgccagaacttggaagtacccaagatgtcttccaccaagtgaattaataaacaaactgtgttgtagccatacaatgaaatctgattcagtgatttttaaaacacaagctatcaagccatgaaaagacatggaggaacttaaagtacataatgctagaaagaagtcagtctggaaacctgcatactctatgattccaactctaggacattcttggaaagtcaaaaagatagaaatagtaaaatgatgagtggttgtcaggggtggaggagaggaggaggcacgaaatggtgaagcacagggaattttcagcagtgaaactattttgcatgatgctgtattggggatttaggacattatgtaattgccaaaacccataatctgtgaaactcaaagaatgaactctaacgtaaactatggactttagttgataatgatgtatcaacagtggttcatcaattgtaacgaatgggctacactaatacaacatactaataggggaaattgtgtgctggaggacaggggagcctaggagaactctctgtactatccactccatctttctgtaaacctagaactgttctaaaaaataatgtctattaatttttttaattaggatgcagcagccccatatcaaggttttggtggcatcctgttattgtgtggttagtacttggcattgaagtgcaccaacctggagtcagagcagttggagatttcaatgcctgtgccatttacctctaaccctggggtgcccccggaatacagctagcagatcagttaggtagaagcagcctcagcaatctagacagtgcaggcttctggtaaggacaggtacaaaccatctgggtgggcagaacttgatgaagactaggaaccactgagactcagcagctgccccagtggcacccacaaatcaaaggagggggctggaaggagctcagggctacacgataagctccctgcctgcaagacagaagcagctccagagattttggtaaataatgtaggtttcagtaccgtgtggtctattcaaaaaagtagaacaaaaaggaaagaaaaagagacagcatgagagagagagaaagaaaaaggaaagaagaaaggaagaaaggaaagaatagagggaggaaggaaaggaagaaggaaggaagggagggagggagggcgggtgggcaggatggagggaaagaataaagagagagagagttggagggaagtagggaaggaaggaaggaaggaaagaaggaaggaaggaaggaaattaacaaatttacatgaagatgagaacatccaggggaacttacaccaccaatattttccattaacaggaacatgctaactagttattagagagagacacactactgtgaaaccatatactgtttccatggggtacaacaccttcctcctcctctgaaacacattctgtctctggcccactgttgccagagacactgagtcttatctttggataagttctggtgcccacaggaatgagatgagatggtggactccagaacatcaggccatgacctttcctgctgctccttgtccactccagaagctatccagctgcaggtgggggcctcagcccctgggtctgacataatccatttgccattctcaatggacttctctccttgcactggttcccactcccccaggacccagtgggtgaccacatgagaaggacacaaacaggccatgtccctttctttctccccctctcaatgcctgcagtggtgggttccattgggtagtgacctgagatttactcattatggggcctctagcccagaccagggcctggtacctaatagtcaccccatgaatgcccagtgaaagaaggtgtccaccacaaggtcctggggaaccaagaattccaccgtggcccataaattctaagtcctacaggattctggaattggagatgggaaaggccttcaaaagtggccactcttttaacctattatactggcaactgagccatgtttccccatcctggacacatctagagggcactgcctaaaaccagacacatctccccacccaggacagagcaggggccttagtctgggggatgcgggtggacagggagggggtgagccacaaaagctgaagaggagaaagcaggtgaaagggtacagcagggtggaaacacagaggaatggaggcagagaatgggggttgagaggggaagagacaggagagggatgcagatctagctactaaggaaaagtcctggagagaacactgtcctctcctgaagtaaaatcactttcacctgaccacagcacttcaggttgagggtggcacaggctgtgaatatttgttcattcatttaacaaatatttatttaatatcagtttcatgccaggcaaggccctgagatgtttagggaccttggcatcttccctttacatctgagtcataatagaaagagggccctctgaccccatcaagctggcaatgcctcaggatttttacctgttggatctagcagctcttcatgtcggcccacaccatgtgaggctgctcttggtgcactgaatggggaagtttctacgtcagtgcctcggagagtccactggaagccctggacagtgggagtcggtggcaccccaagggtggaggccaagagcacacagcactgaagctccagacaccctcaggaggacggtaagggactatcagctggtgagagcctgggtcaccaggaacctttgcctgggtctaaataggatttgccttcagattgcctatgaaataaaagaaagaaatcaaggttaacattgagatttggggcttcagcaacttgaaggatggagctgccatttacagagactgggaagacccagggaggagcaggttgaaaggtggtggggaactagagttggttgggtttctgtcatatgtaatcaacagtcctgaccacctgtaatcctagcactttgggaagccaagacgggtggatcatgaagtcaggagatcgagaccatcctgcctaacacagtgaaaccccgtatctactaaaaatataaaaaattagccgggtgtgttggcaggtgcctgtagtcccacctacttgggaggctgaggcaggagaatggcatgaacccaggaggcggaggttgcagtgagacgagatatcttgttactgcactccaggctgggtgacagagtgagattccatctcaaaaaaaaaaaaaaaaaaaaaaaaaaccagtcctgaccagcctgggcaacatagtaagaccccgtctctgaaaataaaaaatgaaaaattagccgagcatggtggtgcacacttgtagtctcagctactcgggagtctgaggcaggaggatttcttgagccttgagttagaggttactgagctatgatgacaccactgcactccagcctgcggggaaaaaatagagtcctgactaaatacttgagtagccagggaagttttcacaaagtatttgaggcagatcttagtgaacaagaatttgattatttctgttagggaattaagagagtgtgggtgtagttgcttaatgcttattgaactatctttggaatctcatctattggtctatctggtctatctgtacatgtatattctatacactgtctcactgaattttcactaggttatgctacagtaacaaaagccccaaaatcttagcagctacacatacaaaggtttatttttcattgacatatacctttttggcaggttgactatgattctgctctatacaagctattttatttgttagacggttgaaaactgtcatacttggagattgttgaatacggtattagtatgttattcattcattcatttaacagatatttattcgatatctgtttcatgccaggcaaggtcaagtactgagaatacagtggtgaataaaagagacaaaatctctaatttccaggagcttatgttgaaaatgagattgaacacatacaaaataatcataataacaataatgagccctctccctctccctctccctctccctctccttctccctctccctctccctctccctctccctctccctctccctctccctctccctctccctctccacggtctccctctgatgccgagccgaagctggactgtactgctgcgatctcggctcactgcaacctccatgcctgattctcctgcctcagcctgccgagtgcctgcgattgcaggcgcgcgtcgccacgcctgactggttttcgtttttttttggtggagacggggtttcgctgtgttggccgggctggtctccagctcctaaccgcgagtgatccgccagcctcggcctcccgaggtgccgggatggcagacggggtctcgttcactcagtgctcaatggtgccaaggctggagtgcagtggcgtgatctcggctcgctacaaccacctcccagccgcctgccttggcctcccaaagagccgagattgcagcctctgcccggccgccaccccgtctgggaagtggggagcgtctctgcctggccgcccatcgtctgggatatgaggagcccctctgcctggctgcccagtctggaaagtgaggagcgtctctgcccgtccgccatcccatctaggaagcgaggagcgccacttccccgccgccatcccatctaggaagtgaggagcgtctctgcccggccgcccatcgtctgagaggtggggagcacctctgccccgccgccctgtctgggatgtgaggagcgcctctgcccggccgccccgtctgagaagtgaggaaaccctctgcctggcaaccgccccgtctgagaagtgaggagcccctccgtccagcagccaccccgtctgggaagtgaggagcgtctccgcccggcagccaccccgtccgggagggaggtggggggggtcagccccccgcccggccagccgccccgtccgggaggtgaggggctcctctgcccggccgcccctactgggaagtgaggagcccctctgcccggccggtcgccccgtccaggagggaggtgggggggtcagccccccgcccggccagccgcccagtccgggaggggggagggggggtcagccccctgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggtgggggggtcagccccccgcccggccggccgccccgtccgggaggtgaggggcgcctctgcctggccgcccctactgggaagtgaggacccctctgcccggccagccgccccgtccgggagggaggtgggggggtcagccccccgcccggccggccgccccgtccgggaggtgaggggcgcctctgcccggccgcccctactgggaagtgaggagcccctctgcccggccagccgcccagtccgggagggaggtggggggatcagccccccgcccggccagccgcccagtccgggagggaggtggggggtcagcccctcgcccggccagccgccccgtccgggagggaggtgggggggggtcagccccccgcccggccagccgccccgtccgggaggggggagggggagtcagccccctgcccggccagccgccctgtccgggagggaggtgggggggtcagccccccgcccggccagccgccccgtccgggagggaggtggggggatcagccccccgcctggccagccgccccgtccgggaggtgaggggcgcctctgcccggccgcccctactgggaagtgaggagcccctctgcccggccagccgccccgtccgggagggaggcggcggggggggggtcggccagccgccccgtccgggagggaggtggaggggtcagccccccgcccggccagccgccccgtccgggagggaggtgggggggtcagccccccgcccggccagccgccccatccgggaggtgaggggcgcttctgcccggccgcccctactgggaagtgaggagcccctctgcccggccacgaccccgtctgggaggtgtgcccagcggctcattggggatgggccatgatgacaatggcggttttgtggaatagaaaggcgggaagggtggggaaaaaattgagaaatcggatggttgccgggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttaaatggattaagggcggtgcaagatgtgctttgttaaacagatgcttgaaggcagcatgctccttaagagtcagcaccactccctaatcttaagtacccagggacacaaacactgcggaaggctgcagggtcctctgcctaggaaaaccagagacctttgttcacttgtttgtctgctgaccttccctccactattgtcctatgaccctgccaaatccccttctgcgagaaacacccaagaatgatcaataaaaaaaaaaaaaaaagatatggaaagattgtaagtaaaaggatttttcttaataaaaaaaaaaaataataatgaatactatatttacaaataatagctgtaagacattttagcacctgttttaaattagaaaaaatatagaaattattaaaactaaaatggccagatgtgatggctcacacctgtaatcccaacactttaggatgccaaggtgggagaatcaactgagcccaggagtttgaatctagtctgggcacgataggaagaccacgtctacaaaaaataaaaaattagctgggcacggttgtgtatgcctataatcccagcactctgggaggctgaagcaagcagactacttgagcccaagagttcaagaccaacctgggaaacatgttgaatccccatcgctacaaaaaatacaaaaattagccaggcatgacagcacatgcctatagtcacagctactcaggaggctgaggtgggaggattgcttaagccaggaggtggaggttgcagtgagctgagattatgccaccacattccagcctgggcaatagagtgagaccctgtctcaaaaaaaaaatgcaaaaactaaaataaaattgctacaagattaatatataaaaatgagttcatattcttaggctaggcattgatttcttttttctttctttttctttctttctttctttctgtctgtctgtctcttttttgtacaagacagagtcttgctctgtcaaccaggccggagtgcagtagcacaatcttggctcactgcaaactccgcttcccgggttcaagcaattctcctgcctcagcctcctgagtagctgggattacaggtgcccatcaccacacctggctaattattgtatttttagtagagacggggtttcaccatgttggccaggctggtttcatactcctgacctcgtgatccacctgcctaggcctcccaaagtgctgggattacaggtgtgagccaccgcgcctggccgggcattgatttcttaaacaggacacaataagcagtaaccataaaggaaaagattaataagagtatatttcattaaggctaacagaaaaatgtgttcatactcttagactaggcactgatttcttaaacaggacacaaaaagcagtaaccgtaaaggaaaatattgataaagcataatttcattaaaattaagaaactccgccaggtgcagtggctcatgcctgtaatctcaacactttgggaggccgagccaggtgtatcacttgagcccaggaattccagaccagcctatgcaacatggcaaaaccccatgtctactaaaaatacaaaaaacagctaagcatggtggtggtctcctgtaggtcccagctacttagggcctgaggcaggaggatcacctgagccttgggaggtcgaggttgcactgagctgtgattgtaccactgcactccagcctgggcaatagagtgagatcttgtctcaaaaagaaaaacaatttagagaatctccattcatgagaaaacaccattaaaagagtgaaaacacaagctgcaatttgaaaaaagagaaatgcaattcatatatatcctagaaaggaggcatatccagaataaagtattacaaatcaacagaaaatcatatcaatgaaaactggataaaaagattaaacagtcacttcataaaagaggacacataaatggcaataaaagatactcaatctcaataccaggaaaatggaagttgaacccacattgatatattactgtacctctactagaataacaaaataatttttaactgacaagcatcagcaaggatgtggggtaactggaatattccctgctaattggtaaaactactttgggaaaatgttcggcaatacgtaatactaaagttttatcattcatatagctctaaaaccaacaatgccactcctacatatacaccccaatacagtaatgttctatttcttaatctgtggtggttcatttagtaaaaactcatgacctgtacttttttttttttttttttttgagacagggtcgcactctgccatccaggccagagtgcactgacgtgatcaccgctcactgcaatatcaacctcccgggctcttttgaccacgcagttaatttttgtatatttagtagagatggcattttacccaggctggtctggaactcctgggctcaagtcatccgcccaccttggcctcccgaaatgctggaattacaggtgtgatctaccacacccagaccacctgcacatttaaaattgtgaacttcctctgtattcttcagtaacttttcgaagatttctttgacacgaagttctcagaaatcttaaagctaggattttagaatagaaaaaaaaagcttttggttcactggtgaaattttactaattaaatttaaaaacaaaaagaaagttattaatgcatatcacctcagaacaaagattaaaaactacgagcacatcagttttctttaacttcgtgaagcactgggattcattctttcggcaaagaaaggatgaacaacactgtaactcaaagaaaagataccactgcaagaaaaggccttttttttttttcttttttctttttttttttttttttagagggagtctcgctctgtcgcccaggctggagtgcagtgacaagatacctcggctcactgcaacctccgcctcccgggttcaagcgattcttgtgcttcagcctcccgagtagctcggactacacgcgcccgccaccacgccttgctaatttttcgtatttttagtagagacgggttttcactgtgttagccaggatggtctcaatttcctgacctcatgatccgccacgtcagcctcttaaagtgcttcttttcgaaagcagctccaccagcaaaaggtaggaggaaagcgaggaaaccattccaaaagtcttggttaactcttgggtgaaaggacgccaaatgagatgatctaagaagcctcaaggaaagaaagacagacagacaggcacaggaaaatcacagcaactctttggactgcaaacaccaacaccacagtccaacctaccagaaatcctgctgtgaatttgaggcttgtcccgctagtcatgaggtgattcagtgatggctacaaacgctccttacgtgcatcctggacctggtacacctggcttgcccatcaccagcctggagacaccgccaggagcacaatccctgaggccaataaagaccccagctttgcaagtcaggggcgcgagcactcttgcccctcaggttcccagaagaaaccgccacgagggtggggtgcggggtcagtgtgctccacaggacttccgaggacgtgccccccaagctgctccgttcctccaccccctgggatgccacagaacacccgccagcgagtttcttccccagcgcccatgagaggaggctgcgggcggcagccgcaagcgaggaatccagcgcagggaaagtagccccagtggggcccggcgcgtcagccccactcgcgtggcaaaacttgcgggggcccccgcgtgccgcgcctcagcccagctgtgcgcccgcaggtcccagactcgccgcccgcctgacctggcgcggcgccctcacctcggaacgctgggtggacttcgcagtaaaccttaacttcccatccaggcggcagcggcgcggtgcctcggcttcgctcctggcaccgcaggtcgcccgttccgcgttcccaaaagcatcaggctcacttagaagctcaggcagcctcgcgaccctcacctacccctcccagcaccgccgctgtctctaccgccgcccagcgcaggcgtagcagagacttaaaaggacacggccgcctctaccgcacaacgggttggagcaggttaggggccgcaggggctgagaaaacgagtaacggaggacagagtgcagtggggacggggaaatccctctcctccccctctttttcaaagcaccagcccttgaccctgcaattcgctgatttccccggccactggaagcgcccctgccaggttaaagaggcgggagacacaccccctctggagccgggagctaccgggcgtttaggactccaggcctcgcccttccgcaccgccccaaagtctgacttgcaggctcgggccgcagacccgcaggcttcagaaggcagccccagctcccccgagaggtggccttaggtcactcgcaaaaacagtaaccaacgtgtcgatggcacttgtattttctaatttaaatttataacacatttcgcagatgggcttccactgaaataagcctttgagaaaaagaaaaacttttttttttcaacaagattaggaaataccaagacatacgaagtaaagccatgccgtccacccagctaaaaactttgaaaacttgaaattttatctaaggcaaatgtttgcataactttaggtcgtgccattatttaaagtaaatttcaattaacaatatcttttgcaattgaatccatcttctataagaaaactaagatacatccctgataatctacctctcccctcctgtattccatccatcagcaaatcctactggtttttaccttccaaattttccttgaatctgtcctcttctgtctcctccatcaccaccctagtctaggctaccttcacctggggagtgggggtggagggactactgacctagtctccctgtggtttacccatatcccctttatcgcctctctaatcttaacacaacaggcagagtggctttttcaaaatataatgtgaaccctgtcacttcccagcccaaaccacttaagcaccttcccattctcttagacaaaacctcctaactaaccaagccctgaatggccaggcaccttgcccacctctccacctcttctcacaggtcagaccaattccattcttttctctctgctccagccaaactggcctcttttattgcctatttacccagcttcctggactccacagagcttttgctcatgctttgctctgtgcctgaagattcttccaaccctcatcattctgacaacagctgtagtctccacctctgagaggcaacttctgacctccctacagtggtcccttactcttatcacattgcataaaactgtaatcgagtggttatgttggggaattttttaccatcagctccataagtccaggatttggttttgtttggctcatgcttgtatttccacatttgtgaaatacatatttgttcataaatgagaacgatcgatgttagaagttgaagtaaatttggcataaagtcagagaaaggtaaaatgtcacaatctaatatttagagtcagaatctaaaaacttcagttatattaaaactgattttgtatcattttaggctgggttgtcgcagggattctttgggtaatctttaaaactgagttctcagagagcattgtataaacacctgaattaataatgatagccatgggatggtccacataaaactaataatattggttgcttcaagggaggaagaccaagccaggaacagtggctcatgcctgtaatccaagcactttgggaggccaaggccgacagatcatttgagctcaggagtttgacattagcctgggcaacttcgtgagtccctgtctctacacaaaatataagcaaaattagctgggcttggtggacacctgtagtcccagctatttgggaggttgaggtgggaggattgcttgagcccagaaggttgagaggctgcagtgagccatgatcatgccactgcactccagcctggatgacagagcaagatcctgtcaaaaaaaaaaagagagagagggaaagaatcttgactggtggctactggtgggaaggaggtttttactacatccccaattggacctttttattttaaagtatctgaagataaataaatgacacaaaagagtgcataccatcccatttatttgaaattccagaaaaggcaaaattaatctgtggtgagaaaatcataacagcagttccttctagcaggggattcactgggaaggtacacaagagaaatttctgggtgctaaaaatggtctgtcttgataggggtatgaattacttaagtgtattctttcatcaaaaacattcagttaacattcaatgaatgtaaatgttaccttaaaaactataaacataattaaaaatttaaaatctggtcgctaacacctggttgagcgctcagtgtatatggggattggccaaagctataaatacacaattttgtttagtcctcatactgtcctctcaaggtaagtattattatcataatccccttgcatatgaagaagcccaaatttagtaaatactaaataacttgccttactttatgccacctggaaaatggggaaagagctttgaaaaccatcagtcaaatgccagaagttattaaacattagaccctataacacttctctgaaattgtaatatttttggcatatatatatatatatatatatatatatataactcatctactagatcaagagcttcagaatgattgaaatcatagtttgtgttttgtttgtttgaggtttatgtgtttattttatgtcattattttaaagactgggtcttggctgggcatggtggctcatgcctgtgatcccggcactttgggaggccaaggtgggtggatcacttgaggtcaggaattcgagaccagcctggccaacatggtgaaaccccatctctactaaaaatatgaaatcagctgagtgtggtggtgcatgcctgtaatcctagttactcaggaggatgaggcaggagaatcatttgaacccaggaggtggaggttgcagtgaggcaagattgtgccactgccctccagcctgggccacagagtgagactccatttcagaaaaaaaaaaaaaaaaagactgaatctcactatgttgcccaggctgcacttggactcttgaattcaagctatcctcttgcctaggcgtcttgagtagctgggactacaggcacacactatcacgcccagtattttgtcttaagtttctaagcagtcccaacactgcacagtagctgttcaatgtattttgagtgaatgtttaaaaacaagcttggtgttgattttattgctacaatttatatttacatatgtaatatttatattatatgctttctatatatttatatgtgtgtatgtatataattggcaccaacttagcattgctgtgcttaagtgcctgagatgtatctcaaatgaataggcctgaggagagaagcttgtgtcattagctctgaccctgcagcactaatccttatttacccctttctttcactcaccctgagcacataaatatttatttggtgaaagagcttacactttaacatcgcactgaaatagctcattccaaagaaagagctaattctaacctctcacaagtgcttgagcatttgcataagtgaaatttcactgtgtgagtttcacccaacaccacctctgctccagctcctgctactctactgctcataccatggaactccacaggtggagtagaagatggaggatgcacgatgcagtacacagcagcatcctcctcagagagagttttatttgcagtaaattcagtgtgcaataggcaaagcaacgaagagtcaaggtgaggcaggagagcagcagagggaagtggaagttggataaagagtgaactgagtaggagcagaagcaggttaaaaaggtgggtgagcctagaagaaaacctaggcaataccattcaggacataggcatgggcaaggacttcatgtctaaaacaccaaaagcaatggcaacaaaagccaaaatagacaactgagatctaattaaaacaaagactttctgcacagcaaaaaaaaaaaatatatatatatatatcatcagagtgaacagacaacctacagaatgggagaaaacttttgcaatctactcatctgacaaagggctaatatccagaatctagaaagaactcaacaaacttacaagaaaaaaacaaacaaccccatcaaaaactgggcaaaggatatgaacagacacttctcaaaagaagacatttatgcagccaacagacacatgaaaaaatgctcatcatcacttgtcatcagagaaacacaaatcaaaaccacaatgagataccatctcacaccagttagaatggcaatcattaaaaagtcaggaaacaacaggtgccggagaggatgtggagaaataggaatacttttgcactgttggtgggactgtaaactagttcaaccattgtgaaagacagtgtggcaattcctcaaggatctagaactagaaatactatttgacccagccaacccattactgggtatatacccaaaggattataaatcatcctgctataaagacacatgcacacgtatgtttattgtggtactattcacaatagcaaagacttggaaccaacctaaatgtccatcagtgatagactggattaagaaaatgtggcacatatacaccatggaatactatgcagccataaaaaaggatgatttcatgtccttcgtagggacatggatgaagctggaaaccatcattctcacaaaaaaccaaacaccgcatgttctcactcacaggtgggaattgagcactaagaacccttggacacaggaaggggaacatcacacgccggggcctgtcatgaggtggggggaggggggagggatagcattaggagatatacctaagtaaatgacgagttaatgggtgcagcacacgaacatggcacatgtatacatatgtgacaaacctgtacattgtgaacatgtaccctagaacttcattaaaaaaaaaaaggtgggtgagcaagaagcaagataagcagaagttgagcagcgaaaacaaaagtgagatggagtagtgagtaaaagcttatggctggcaggatccagagcaaaccagtaagaggcagctcctcagagataggcatgggtatgggagagaaaaagtaggcttaaaatgaccccgtatgataatcagctcattaaagctaatgcatatggactgcatatcatgggtgtacttaaaattatgggatggaggtgaccgggaagcacactggggccaaataactaagcaacccacctatcaatcagaaggcacatgctgggtagagattaggcagccccaggaaaaggagaaaaaatatatatataaaaagacccaaagcccaaagttcaccaaactgatgctgatctcattttgcagaagttagcctgttctcccctctctgagagtgttactgtgcttaataagtcttttgctgctttgctacatgtgtgtgtgtgtgtcacagccaattctttgtttgagacaccaagaacctgggacttcacaacaccagccagtaacaaagatatgtaagcttgggagggaggaaagaaagaagggagcaagaggagattcagacatgagatgcattcaccctatgagttgaaccccagtctccagcgtgggagttggcaattctattactgaaccatcaatgctccatgtggtataacctctcatgatttttgtttgtttgttttgttttgttttgctttgttttttcaaaaagagaatctctggtggtataggcaggcatgaggggtcagggaggatggaggtgggaaagttctataataggctgacacagatatttttggaaaacagagctaacaaagcaacaggcacttgaagcaaaggcttgccctaaaccttccactgtttgccaagggaagaaattttggagtcaaattttcactttctctcttgtgtagatctctgtaagacataaaagtttggatgacagtcattttgattcttggactttactagagactccaaagacgcatctgaggagaaaagctctgggtccctgggatgactgtgccactcgacatagcctcctggagtggccaaagagagtgtggttgaaaaaagaaatattggagtgaactttcactcactcccacttttgtaggtttcttaaaaacatgagtttagaaacaagatactgggctttttcaaatgactcaaaagaggtgtagatgaagagaagctcgatcatcccacagatcttttggagtaacctggacacatccctaaatctccagctcctgggtctttgaaagccagtttgtctcagggttgggaggcaagtgtttggaaagcaccaaggcaggagttggcaaaaaggttacctcatcagtgaagaaatgaaatttccagaagttttcaccagatctgggaccagagacaaaggcctggatgaatttcctatgcaaaccttttttagaacctctgtttcagagttcttccagagactcttcaaaattagatctggtgaaaccgctgctggtggtggattggtagttcagcagcagaatttttttctcccacgcgggagactcggtccgactcgcggccatgcaggccttcttacccttcaggcaggaagggctactacctttctacccaacaaagttattatattacccaggctgtactgcatttatggaccttggtcgtggcagctacaagttaacctgaggggcgtgccacctctggagcattctctgtgctcgaactaatcccgggatttacagttcctgtgctcgaagcctgtccttgaaagtgaggagtgtttccagtaggttgctgtagttttgaatactgggaattaaaacctttgctactttcatctagtctccggggcaaacccctgggtaacccaaaggccatcagacggattcgcgtgctgggctttccactaccttaggccacgtgtcactatggagcgaagatcaagaaggtcccggaaggagagaagctgcggggtccagggagactttttggtggttggtcggagaggcttcagctgcccaaggaaaagggaagcgtgtggggaggtatccgcatagagatgagggcctcggcggagacagtctcacgcagaggtatgccaccttggcatctgcgccttccgtgggccagtgggtcttccgggagggattctgtgtccctggtattgtgtgtcaacaggtgttagcctgatagttatatttttaatgagagaaaacgaactacagaatttgcgagttttgttttttttctggttttgctttatacctcttggattctccttccaaaggattccgatctgaggggcattggggtgtgactatggtagacaaggagtggtgaattttcatccaaaaatctttggcggattcccttgctctcccgctccccagtctaacagtagtttaaaacagaagatcagcaacatttggagagttttttttttctctgcattctgatgataaacttgatttattcaattccaaaaatttctttattctgaggttgtctttctatattttgagtataaaaccatggccatacaatgttggacccaccaaggttcttctcttcacttgtttatttgtacagtctctttgtaatctcagaatttcttgagtaaactgggaactgttatacataattctgtgtttttgagcattctttgtaaacaggaatcaggattgggggtggggaaggagggaggagtgggagtgctgatttgtgtaacggaaaaatcatagattacttatgtgatggggcaaaggttttaaaaactcttagtgtcctcagatttccccttatactatttgctgaagaaaatcatgtccttgactcccttccttaccctctcctggcaagggaaggggtcccctcctgcctcagggtctctgtcctcctggggttaggagaagcgcatccaactccctctccaagtgctggagaggaggctaagtctttcccatgggctgggggctttgctgtcccaaggacggctggggaggaagaggaggcagaggcggaagaggaggcagaggcggaagaggaagccggctgagatttgtgaagcagctcttgctaccgcgggtaggagagggcgcgcgggacccaagagcctccgtgcggagccaggcctcaggagcagccgccttggtcctggaagggatgcctccctccatcctgtctccaaagaatgtagggagaccttctcacccggtgggaaagcgacgtctcccatgctttcccaccacggacgccttatgtcccttttcctgctagtgtctgaccgccagcctgcgggggctgcggctgcaacggttccaagctgggtggaggctgcctgcccgcgagccaagagccacgctaggaggcaggagtcgggaagtcgtgtgcaggcccggaggagactcaagctacgggtcaggcttttttgccaattgccaaattcagcgtgtaaaacagagagctcacatctgtctgtttgtaagcttcggtgagaacaacaaggaaggccctcaagatccctaggagggcggcgaagggtctctggcgaagggtcaccgcgtcggcggtgagccaaggtatgtcaggagagagtgcgaacccagcccccgggtagcacgaacaccaccgcagacaagggccccgcttgtggggaaatcgcagggccagtgcagccgcagtgcggtggactagcctcatccagggagaacccccttcctgaccacggtctgtcccccgccaggtaagaggagaggagggacagtacagcctcctgtcccgtagccgcaggctcagggtcaccaccttcccctctgcttggccggcgccattcttccaaaccactctccgccaaagattccacggacagtcacctacaagacaacccagccgtcctttcagcagcggatcccgccccgcagccaccgcgccctctcaccccagcgcttctacccaccgcctctgcccagtctgtgcacttcacctccctcgccccggctcccctctgagcttacagtggacagggggttcgtccccaacccttcttgggaatactgaatagaaaagggaggagcgtgcgcaattccttggtagtgtgtagacggacattgtgggatttgactgtggtaccatcgctttgacgtcctagtgatttttacacctgccttctgcttagaacaccggccacagttttccatttgtgtctactccacctgctgtctttgttggataagtgaacatcgtccccctctaccactcaatcaacaaaagggcggtcctggaggacctcacccgccgctcacctgctgctcacccccctcccaaccttgcggacatcgcctccggtcgcctcttcgtaaggcctaagaagcacgttagctgcgaacggaggtgaggaggctcagctgaccgcctgtgtcagctgacaacgtgtgacacgcacaaacgccaggacttggcttggcctctctcttagttatttgcagctctgcccaatcggcgcctccgggacggcggagacggtgggcttcttgggtgcagctccacgaaggctggcatccctgcacagcggtgaacacctgagggagacgctcagtctctctctaaagccacttctgcggatgacacggagataaataagagcagtgtgtcatgagaggccgtccaccaggacttgccctcctttgccagggtttgcacctagcagagagactgttctgcctctggcccttggagcaggctggctgacagcggagtaaagaaaaattactgcgggtgtgcagtcagtgcaaaacaattctctgaccgataattgaacccgggatgcggtggtgaaagagctgaatcatagccactagaccagcacgggggcacgggagggtctttctcaaccttcttgccatataagtgactgtttccctgtgcgctgggaggacttgggccttgtgggggtcgttggtcgctcctggagtcgtctcacaaggcctttccctccctcctttctccaaaagaggagcccggaggcgacgcacccagtactctgcgaggcccaccaaggccacgagtcccgagtcctggagcgagttgcagcgtccaggctgcacctgaccactgacctagaaatgtgcctttgcgaagcggcagcgcatggagaaacagtcgctggtggccagggccagagtcgcgcaccgggtagccagaacaggcaggagcgaggaggctcccggggtgagaacggggcaccccgcacatcataaaggactcagaccttggcaaccccgacatcataaaggactcacacggatgtggaaaccgagacgagctggatggaaaactttccaggggggctccggggccctcaactgctctctgaccttcccctgcaacctgcgacacctgccattttcccatcttaggcgacggcaacgctacccttccttatgctccaggcaaaactcctagagttccctctgacgctggagttttttcctcaaatccaaaatccaattggtcaccaattcgtgatttcccgtcggccaagtgcgtgggcattgatctacacgcgaatttctccacctcggcggaatggccacttaggggtgggggaggggccctccggtggattgtaaggtgtttagcagcatccctcgcctccgctgactagatagatgccaggggttaacattctccctccgggcttcccctagtctggcctagtgtcccagcggggatgggggagtagtctgagggtgaagttgccgcctattgagaaccactggtgctcatagtcctgccctctgagcttgtgcagaggactctccagatgaaggctcaggggtcgatccagctcgagaccccctcgctccccccgcacagtcggaccttaaaattggagggttttaacatctcgacatcatgagattctacctttaggtcttttcttccgttctgtccgccaaatcggcctcttccgagtttgttgaccagggccagccaggcagaaggctggtttcgctcaaagaggatcccctcgccctcctggagcttcaggcctgtttccgttgggtctgcagagaagccttaggggccacttccttcggcatggggagggggaacaggtgctcgctgcgcggggaagaagagggtttgactgctgttctcgacccccagcgccaaacctccaccccggtgcgcgcccctccaggctcctgctggtcccactcgccggtaattaggtctccggtcagcctcagctcccgagacacccaggcccagaaggacacgtaagggaaagcagctattcacttcggtcctgtccgcaagggatccctttctgacgggaaagaaaggtggcgagtcccgttctgttgagtaagcggaagagagatcaaagggaagagaagaaaaatcctgtgaggtttcaggatctaaagttaccatgaagtcgacctaacctcgtctggaggtcctcccgtggctggcgaaggtgagtcgagtctccgtcttcagtttgtcaaagtggacaaagcctacgacaactgccagtaccagctactaggcatccgcagtctttccagttggtggtactggaggtccctacccaggatttccgtggattccaagggtacaactaaacagcttttgttgttccaactgctcttatttgaagaaagggccgatctgttgagaatcacataggaaaaccacttccataagagtgtagctactgttgttgagactgtcacattctccctcctcctccttcctcttcctagaaatgtgcaatgaaaattaatccccacgatcggcctgttgtactttcaatgtacagttggcagaacctaaggtaactctaggaggttccgggatgaatatttgaagtatgacacagtcatttttatttgcacgtgcattccaaaaacacattggacaaacacatccagttcacctgtgccacacttacaaagacgcgaaaagaggggctacatacaaacaagtgaaagatgtaatcaaacggcttttaaatgtctgctgtttccactgaaggtcttcttctctggatacacctaccagtgtcttctctttctccaaaaccagacattcaagtgccagaccctgaaatcagttttctggttccaacttgttcttccccattctgtatctctgcccctccactctcttctttcatatgcaggaaagttcagctctccctcagtttccaatttgcaacatcccattcgaagaatgcaatgaccagcatcaaaaattagacaccttccatgggactccgtctctctcttagttggagcttctataacaatgtaccataaattgggtgactcatcctaaacagacatttctcacagttctggagttttcaagtctaagatcaaggtgccagcatggtagggttatggtgaggaacctcttcctggtcgtagactgccgtcttcccactgtgtcttcaggtggctgaaagagggggaaagagctctctagtgtcccttttatgggggcactaatcccactcaggaggactccactctctggatctaattacctcccaaaggcccctcctaataattttaacacatttcctggggtgggcaggggaaggttagggttccaatcaaggtattttggggggacacaaacattaggtctcccgtgatctttctagaagaagaaattatacatgacccaaagttttgtacatttcacagttagaaataaagaaaactttttctaagattttgaaaggcctgaaacgtgaggccaaccaaccccatcactaaaatctggactctgtgctgattgttgtggactttttgcgtgttcatcctccctgcagacaactgaagattcattctctccagagggtagaagagaagatgtattgggagaacccacccccaatatttcaaagtaggttctttctattttccgtaagtgtcagctggctgaaaaataaagagacagtacaaagagaggaattttgcagctgggccaccaggggtggcatcacatatcagtaggaccatgatgcctgcctgagtctcagaccaccaagttttcattaagggtttcaaaaggggagggtgtgtaagaacagagagtaggtacaaagatcacatgcttcaaagagcaaaaagcagaaccactgataagggtctaacaaagatcacatgcttctgagggaacagggcaaagggcaaaagcagaaccactgataagggtccaacaaagatcacggggcaaagggcaaaagcagaaccactgataagggtctgtgttcagtggtgcacatattgtcttgataaacatcttaaacaacagaaaaaagggttccagagcagagaaccggtctgaccacaaatttaccagagctgagttttcctaaccctagtaagcctgagggttctgcaggagaccagggcttatctcagtccttatctcactgcacaagacagacattcccagagtggctgttcatagacctccccccagggatgcattcttttcccagggtattaatattaatattccttgctagggaaagaatttagcaataagtttcctacttgcacgtccaagtaggccccctgcaagaagaaaattatggctctttttgcccgaccccacaggcagtcagaccttctggttgtcttcccttgttccataaaaattgttattattctgttctttttcaaggtgcactgatttcatattgttcaaacacacatgttttacaatcaatttgtacaattaacacaattatcacagtggtcctgatgtgacgtacatcctcagcttatgaagataacaggattaagagattaaagacaggcataagaaattataaaagtattatttgagaactgataaatgtgtatattaagatgaaatcttcacaatgtatgttcctctgctgcagctgcagcttgtccctctgtttgggttcccttacttcctgtaacaaggatccttggccccaagggggcaatcagcatagatgagcaaagacttgtgtcccacactgaaatgagagggatgaagtgacagcatatcttgatctatgtgatggttacataagttatgacctatttcaaagcttattatgctgtgtgaaaaagaacaaaaccagaggacttgcacaacctgacattcagactcactctaagctgttataaacaaggcagtatgcaagcggcattggaagacacaaatacatcaacagactgacttgggagatctgaaactgaccacagctgtaaggtccataggttttttgtttgtttgttaatttctttttgttttctgagacagggtctcactctgtcacccaggctggagtgcagtggcctgatctcagctcactgcaaactctgcttcccatgctaatgcaatcctcctgcctcagcctcccaggtagttcatactacatgtgcattttagtagacatgaggttttgccatgttgtccagactggtctccaactcctgggctcaagtgatccaccagcctctgtctctcacagtgctgggattacaggcatgaaccaccatgaccagtcacaggttttcaataaaagcagttcaatggggcaaaggaaatagtttcaattaattgactttcacaaagaagaaaggggagatgaacaaggttatttctccctcacactacacttgaaagtaacttgaggcacattatagaccaaaacttaaaagctaaagatataaagcatttcaaggatactttgtgacttgttggtagacagagatttattaaacagggcacagaaaaaaaatgtataaaggaaagacttgataaattagacttcatcaatattagccatatcttctcatcaaaagatgccacaaagaacttgaaaaaatgaatcagcctcagggagaaaatagtcacaaaacctatctgacccccaaaccctgtaactataatgtatggtgagatcttcttacctggtaacgaaaacaacaacaacaaaacaaaaacaaaaaataatcaacccaagtatgctagaagggtaaaagacttgaacagatacataagaataaaaggtacacacatggtcaataaagcacatacaatatgtttagttatcaggaaaatggaaattaagaccacactgagacaccactataactcccagtagcatggctaaatttatagggagaggaaacacccaatcttggagaagatgaagaacaaccacaactctcacacgtcattggtggaaatgtaaaatgacacaactactttgggacgttttgtcattttttatgaacttgcccatatcccactctttggtaccagcaattcggcacccaggttttcccaagagacacgaaaacagatgccctcaaaatctcttgtgagaagaaagttcaaagcaggcttattcagaatagccaataccagtttattcagaatagccaatatccagactctcattatgagggtgggggtggggcgggaatggcaaacaaactgtgctgtttctttgcaatggaatactactcagcaatgaaagaggaatgaacttctgctacactcagcaatggatagagccagagacattatgcagagagaaagaagcatgtagaacagagtagatgcaccgtgattccatctgcgtgaagttctagaagcaaaggtaaagtgaaaacaatctggagagtgattgttcacaaataaggcagaggacaacgacaatgatttttataattctagtgattacgttgttgattgagtagtcactaaatccaggcacatctgacaacaacggtgtaaggcagagtttgcgaagtggcacaaccttccatagaaaaaatgttgaggcacataaaatgtaagatacttaaccaaggtcaggcaaggactgacacagatttccaacacagaacctgggttcttggacatagattagactggacctgtccacttctctgtttcaggtgtctctgggattctcagctgcaccagaggagagagagaaggacagagaaggagacagagggagagaggagtagggaagaaatggagggaggcacagggcctgtagctgttgaagagcagagaagtaactcttgccagtgtatttacagtatagaaaagttttctggcgatcaggacattagcagatgctaagcttgctgtggtcaggagatgaatttgatatgccatagatttagaaattaaaacgaaaccctaaagttattggaagagaatgtagcagaatacatttctgccttaagagataacaggaaaaaataaagcaaagtagaatttaaccaaagttatcaacttctgctcatcaagaatcaccatgaaaagggagaaggtgagccacagactgggagaagataattgccccgtgtttacctgaaaaaaaaaataactcaaatcttgaatatagagagtactttttacaaatcagtaataaaaggcaaagccaattgaattagggaaaatgcttcaatagcctctcttctcaaaggattgctaaatggtgaaaacgcattagtaaatatgctcaacagcattactcattaaaggaaacacaaattgaagccatgatgtggtaccgttttacatccaccagaatgggtgtatttaaaagacagtaaacaccacgtgctgtcaaggatgttcagccagtggaactctccttgctggtgagaaagcattctggaagaaaccatttggccgtttctaataaagttaacattacacctaccatatgattgaacaattccagtacttggtattcctcaaaggaaatgaatgcacgtgtccacaaaaagaccccacacaagaagaatcttcattcgccttgtccagctagtggaatctgtttcttaccagcaggagtagaagtctgaacatttctcttggtatcatttctcttggcctcttggtatcagagtcgccaaggaaaatacaacgcagtcaagcactggacggaaaaacaacacattattcacacagagaggagacacagccgggtgtgggctccgcttcagtagtgggcgttggtcccccatggccatctggtccctccatttggcctgcacacacagcctcttgagaagcagaagaaagggcccctccccctcccctcagcggggagcagatacagcagctggccaggtgccagttgatgcacatgtttaagtggaacaaaggggtacacagtctgatcgggggaaagatactcccacacaaggaggtgagtccagcacaggctgtgaggactccttatctcttgggaaggaagtgctccaggcccaaggcccattcctacccggcagagtggaggtggaaagacccctggcacgagattgcctttccccacactttcctgttggcatacaaacttggcgacgagctgggagacaagccattgtaggccacaacaaagagtttgaagtttaaagtcattaaataacagccccagtgactggaaaacaggttctgagggcaccattgccttcgtgtaagccaccaacagggctgactgggttatttgctgtgtgaggctcggaaatggacggagcacgtccagcgcttcccttggattcctcgccaggttagtgggctgtgaggtctcttttcctttccctgaggcgcctggttgcagggagcgaaagtggatagctgacggcctggaagaacgacattgccgtgactcggattcgaaccgaggttgctgcggccacagcgcagagtactaaccactatacgatcatggcgagccacaggccaagcgatgatagctgagcttgctctactaattttgacatcaatagatttcgattattaggcggctttgttcccagacagctacagggggatcgcgctattctttcatacccgctctgcttttccctcccttcctcccaatcctcatatgtgatgagaaaaattcttatctcctccactccagcctgggcctctctcgcgaagtctctctgtcctcattcgcacctcctctacttctctccggcctctccgtatttctgcttttcacccttcctctctcccgccggaccgaccgaagcagaggtgagcgagggtagcgcaagcagcgtagcgagtcaggtgaaggcggagccaagaactgcgagagctgtcactagagcccaccgggcgttctgcttgcttcccttcggacccacgcgattcaggctcagggagtcgcggacccgggcgtttccaggatgctgggtctgatgcctgcgaggggcaggacgaggcgaaggccattccgctgcccttccagcttcagaatcacccaatgcacgggtttcaaccgtagccggcaagctgcccctctccggttttccgaggctttggagcctgcacaattgttctacaaaaggcggtggctccgcctaacgttagatggacgcttgctctgcgtggtgataccagagcgagagtcgactgttcctgtgtcgcagtcgggtggtgtgcttgcttccaagtctggaggcgggtggttcgagctcgttctatggaacgtttcctgcattttaaaaatgcttaaaccgctggcaactttcttctatccagcacatgcactcatggaaaggcagagcgagaccaactttaccctcctctcatccctctccctctccctccccctctgcccctccccctccccctccccctccccctccctctccctctccagacggagtctcgctctgttgccaggatggagtgcagtggcgcgatctcggctcactgcaacctccgactctctggttcaagcaattctccttcctcagcctccagagtagctaggcttataggcacaagctaccacgcccagctaatttttgtattttttagtagagacggggtttcaccatgttggccagggtggtgtggatctcctgacctgatgatccgcccgcttagcctccccagagtgctgggattacaggcgtgaaccaccgcgcctgacactctctgtcattcatttagccctttccatacgcttttgaggttaaattggttctgtgattttactattacatataatgctctagtcattcttgtatgggcactttcagccactggtgtaagtatttctatagggtagaggtgcaattactatgtggaaagcaattactctatcatagtgttcacacggtttttatatcattccattctctctcctctgtttgcttattagatataactctttcttttgttattttagtaattgccttagggcttatagcaaaccattttaacttatcacagtcaaccttcaagtgatattatacctcgccttctggccttgatgctgatgctgtagctgacatgcactttgcttttacgcatgttacaaaccccacaacacattgttattgcttttgtttaaatggtcaaatttttacaaaagaaatttacagaataaaaaaaaaactagtatagttacccatttctggtgttcatttcctcgtgtagatctggattttcatctggtattggattccttctgcctggaagactcctttgacgtttcttgtagtgtgggttggctggtagtgaattctttcagcttttgtacatctctaaatgtccttattttacttccagttttgataatttattttttgtggcatagtattctaggttaacttcccctgccctcagtaccttaaagatgttgcttctatgtctgctcatgtgcattgctgctcctggtagaggccggcaagagcagaaaggaagctgatgcaatcctcatctttgttcctgtgtatgtacaatgtatttttcttctggccggatttgagcaatattattatgaggtatctaggagtggttttcttcatgtttcttgtgctttggtttcctcagctccttgggtcactggatttataatttttgttatgattggggacttttcagctattgtttcttcaaaaattggccggacacagtggttcacaacttcaggaggccaagtcgggaggtgttgagtgaggcctgaaatttaagaccagcctgggcaatgtactgagaccccattcctaataaaagtaacaaagaaagaaataaatgtttcctttcccccctgctccttctcagggacttccattactcataatttaaacctcttaagtctgccctacagttcactgataatcttttattttaaaaaaatctcttttgtctgtgagtttcattttgcatattttcaattattcatggttccatgttccctgatcatttcttctgcaacgtctaatctgctgttgatcccatccagtgaatttatcatctctgatattgtggttttggcgtgatatcggctcactgcaacctcctcctcccaggttcaagtgatcctccggcttcagcctcccaagtagctgggactacaggcatgtaccacgataccaggctaactttttgtattttgagtagagatggaggtttcaccgtgttagccaggatcgtcttcatctcctgactttgtgatccacctgactcagactcccaaagtgctgggattacagtcgtaagccaccgcacccagccccctcccttccttccttccttccctccttccttccttccttgagacagggtctcaccctgtagcccaagctggacttcagtggtgtaatcttggctcacgcaacttctgcctcccaggctcaaacaatcctcccactgcaacctcctgagtagccgggactacaggcacacaccaccatgcctggctaattatttgaatttttttggtagagatgaggtttccttatgttgcccagtctggtctgaaactcctgagctcaagggatcagcccacctcagcctcccaaactgctgggattacaggtgcctgtttgtttgcagagaggagcagtgagcagatttcaggcaggagagttaatcgggcatccgttactcaaactttgccgggagcctaaggcatctctttacatgttcttagtttgacttcaacaggaggtgtgtcagtttatcttccaacatatttttccaactcaatgagagagccttttccttcgtgctcttgccagcacagcagtttccatatatcagtctgatgtaccagtgagggggtggtgccctgcctgatttacctaagcaggaggtgcagcagaaagacatggtggacagttcccagagatactctctggcacgtgttccacagctaaacctccaagatgtttagaaagtcttccagtaattgtaattgttttctctggtgatctacctaagcccagagaaaactggctggagagaccctgaactgcttcctgtcaagaggcttatcaaataggaggggaaagaatggctccttctagaaatttgttccttttctcttttctttatgaattgcattctgcttttgttgaatgcaaacgatctacagactgttctccctcctagacaagggtgaattggcatgctaataactacctctgtgttattccttccttgatggtgtttgttttgttttgtttttctgtaaaactcatctcactggagacaaatctctggatcctgcacctcaccatgcttcttatgcagacctggatccttggagttattggctccctttgccttgtttattttgttgactctcttcagcaaaactgaactccaacttttacaccctaaatctggctcttggacatataggtccttttgctttctgactcctcctcaacccagccctgcctttccaacctctccatctgtatctgtgtgcctgtgtctgtctgtctgtctctcataccccaggctgcccccagtattacccactttcttctccccctcttcagtgttcagggtacaccttcttctctgcctacagagtcccacaggctgagggtgcgtccccttacagagaggggagctcattccagaaggtgccctctagacttggaattaaccctacaaacaacacccaggtttgaaaagctttttctgtcttcccattacctgcattattcaaaggactaaaagtggggagtccagtagaattcttgatgtctctcagaagcctgcattggaatgccttcattcaccgagcatatgttgggtgctcacaaggtgtgaagccttgctctaggtgagtagctgcatggtgagcaagtcctgccccaccgagcccacatctggaggaatcaaaagggaccgggcagtgggaacacaaccagctcgtgtcctccccacaagtgtttccccattcgggcacagggaacacaagcggtaagcatgacagataaagcatagcgaaggatggggaagtgggtgacttcagaccaagaggctactgtggtcatgtgcagtggggccacttccgacaggggaagtgcagggggacagtgtgggccagggagaatgtcgtggatctggcattcctgcatcttgccctcactcacatggcctggtgtcaactcagaaatgtgcccaaccacacaacttctggcctccgtgtcacctagaagacatctagaacccatgcaatagcacaaagaagtgaggatgtgcagcctggggatgggggcatttaataatagacaggtgtctgaggcagatgtcctcagatttccaggcaccacttgcctctttgtggagcaatcagggcaatcatcggcaaaaaactaaagactactcgtcctgttccatgcagaggcgtagttaaccttgtaactattcttttctgaccttcattcttccacgtccagatatatgggggtctttgttgcccatctgcttcaagttagatgaagaaaatcctgcctgaaggcttaagggtttgttagaaaaataaatgctgttcagaaaaggtgcattttaggcaaaagctcagttctggagctccagaacctacctatcccaagcccaatacacacctcctttctctccctccctgctcatcgcacctgccttcgctgattcttcaggctgcacatctctgagaagatgacaatccctagcagaagaacaagagaaccttggacacttctgtccatgaagccatagacgcgagcagatagcctcattccatggcggtgtgactctgaagtcactcaggttttctgtgcctccatttccacattgtaaaatgggcccaataggaatgagtttctgaatgggttgttccaagtttaaataagacacggcagtaaaacattgaacacacaccctgatgcatagtaaacgctccaagagcagtagccattattactatcattatcatcggtggcttcatgacggctattatcgttatctacatccatctttgaaataattgcatatccttttagggtatggagggattgcaacatataacaaatcctaactgatgaacatttcttattacaaatattgctgctgggaacatatttctgtattttaatcatcacctgtgtgtttctctatcaaatcttctcacacaatttggggatgttgcaaaagtcattccctgaccgggaatcgaacgcgggccgcggcagtgaaagcgccaaatcctagccacttgaccaccagacacagaaatctccttgtcagaggaaacaagagaaggtaaagattaactttctaagaggaggagagccccactgaaaatggctctctgtgacccaagcgggctgcaggactgcagggctccaagcagtcactgcccagctgctcaacacctctcacctctgctagcctggccactgctttgggctgtattgaggacaggccacaaggaaactgagcggtgttccattctagccttgctgtagcatggtgtgaggcagagccaggcacttgctctctttccgagcctcagtttccttgccaccaaagtgcggacgtggctctcagagggtgatgagccgagtccttctagttcccgatctctgaactggctcaaggggctctaccgataaagacatgtgtaggggtcccctttcgcccccaactagctcaattagtagagcatgaaactctgaatggatgggtctttggctcgagctccaggtgcagatttaggttcattttcttttgttccgccacacaattcgaccggttccgcaactgagctcgggtcgcgaggaagccaagtgggcttcacaggaaagacctccttggtttcagagacattgtagctgtcagcttgaaatcttcagaaagaagatttcggcgatagatgagaagactggaaatttctggatctaaagctaacatgaagtccgcctcatccggcgccctcgtctcccgatccaattcacggcgggcaaaccaggcctggttcctaatgctcagcgaagggtttcaggtagtaatggaactcctcccgtgcttccagaagctgctgcagccggcggggtttgagcgccggagttccgggcggcagtagtgtggaccccgcccctccaggtctatgggccccgcctcgggaccttatccctggcgtccggccttcagggctcttggctttgacagggtaccgactttcgtggtccttccaggagctgcaggaccctgcctgcccgcccttcactcaagtcaaggggcctcatccctgtgctctttcctcgctttgggctctccactcagggtgtcaacagaggtaggtcaggtgagaaacctggatttccacacacacctggctacaaggagatggcaccactccccttctcctgcagaagcagactcagaaaaaaggtaattaaaacagaaggtttcaataaaatcgagagtctgataacataatacccaaaagtccaagtttctattgaaaatcattcattacactaagaaccagaaaatcttattctgaatgaaaatagacagcaaatacacaccggcaataagatgagagaggggtcgggattgtctgacaaagattttaaagcaagcaagcctgatgaaaatgatgcagtaattatgagcacattcgaaacaaatggacaaatagaaagccttagcaaataaatacaagacttacaggagaaacaaatggaagtattagaagtggaaaatacaacaaccaaagtaaaaagtccggcacataggctcaacagcagaatggatggtgcagagcaaagaaatccatccactgcagatgaaaaaatagaaattacacaatcttaacaagcaaaaaatagactgggtgagaaagtgaatagaacctcagggacttgtggaactgcctcacaaggtctcactttcatgttgttatctatgtctggaaggggaagaagaagaggaagaggctgaaaacataaagaagtcaatggctaaaagcttgccagagttggcaagagacagaaacctacaggttcaagaagctgtgaagaccccaaataggagaaaacccaaagacgtctatggcaagatacatgaaaaaataaaatgtaggaaatgaaagacaaagaaaatatcttgaaagcaacagagaaaggtgacactttacctagaaaggaaaaacaattctggtgatgatggatttctcatcagaaaccaaggaggcagaaagaagttgtgcagtgcttttcaagccatgaaagaaaacaattgtcagcccagactcctctgtccagcagaaacatctttcagggattaagaggaagatcaaaactgtttcagattaagaagagctaagggaatctctgaccaccagttctaccttaaaacaaaaggctaaagggagttctctagacagaaaggaagtgattaaagaaggaaccttgggacatcaggaagaaaatttaaaaaaaaaaaaaaaaagtaagcaaaataggccttccttcttctcttgagttttctaaactatgattgacggcttcagaaaaaaatcatagcatcattcaaagtggttctaactctccaaaaagaaaatgtttgaaacaattataaactgggagggtgaagagaccggtaaggaaggtaactcatctatcattcactcatactggtacaacaatgacaccagtatactgtgtggtaagacatagatgcacagacatatgaatatcagggaaaaccaagagggctatccaaacagatatatgcaaaaacactatggataaggcaaaacaccattctcaaagacgttcaagtcaccacaggaaggtaagaaaaagaaagcatatccagaaaacgacaccagagagaacaaacacaaaaagaaaaatataatggcagacttaagccctaccatatcaatcatcatattaaatataaatggcctaagtacaccaattacaagacagagattggcagagtaggttaatggacatgacccaactacatcctggctgcaaagagactaccttcaaatatgatgatacaggaaagttgaaatcaaaaggatggaaaaagatacatcatgcaaaccttagacaaaggaaagcaagactggctatattaatgccagatatagtatatttcagaacaaagaaactaatcagagacagagagggacattatataatgaggaaacaaccaatccacgaactcctctcctgacaaaagtcataaatgtctatgcaacaacaactgaaagtactgaacagagaactaggcaaatccacaaatatagctatatgcttcgaagttcccctttcttaacaatttatacaaaaaccagacagaaaatcaacaagaatatagaagaacccaacagcatgatcaaccagcggggcttaaattgacaattttagaacacccaaccacgtcagaatacacattgttaagggatgcattgtgcccggcccccccagattcatatgttgaaatcagaacattagtggcaactagtaatatactagttaaaatcacaatgagaaattgctaacatacctatcagaatggccaaaagaaaagcatgaccacatcaagtgctgtcaaggattcagagaaagctggatcactcatacattgctggtggaaatgtaaaaagtgacagcccactctggagaatatctgtatagtttttactttttaaactatatgtgcaactaccataccacctaggaattgcattctctgcatttatcacagagaaatagaatcttatgttcacacaaaatccatgtacttaaagtttatagcagccttgtttttaatagccaaaactgggggaaaaatgtatagacgactttcatgaggtgaatggttaaacaaactgtgatatatatccatagcactgaagagtcctcaataattttttaaaaaacaacaaactattgatacccacaataacctggatgaatctccacagaattatgctgagtggacaaagggtaatcccaaaggtgacatgtaggagtccatttatgcaaattattcttgaaataaataaattataaaaatagggaatagattagtagttgccaggggttaaggagggaaggaggagcagcactgaagagacagggtcatggctataaaaaggcaacatgatgaatcctagtattgatggaaatgttctgtaccttgcttgtatcaatgtcaatctcctggtacagtggcatttgcaatacatttgcaatatttgcaaatattactaagatgttaccattggaggaaactgagtaaaggatacaagggacctctctttttctctctgagttcctaagattgtatgtgaattattaaaatgtaaaaattaacttaagaaaacctaagtatatttctcctttactgatcatgcctttgcttaaaaacattaaggcaacaatatttttcccaacaccctttattttcttgaagacagttttaacaaaagctgttcttagggcttttcctaaaagtttaaaacttccagtaatccttactgttcttctttgagaaccctccagggttttgttttccaaaagaataaagacaaaaactggcaactggcatataatactatattagtcttagttctccagagaaagaaaatgagcaggatacacacacatacacacacagaagcagagaagcccaagttctactctgagtaagctctagacctaggagagtcaaatatagttcaagacaaagtccaaggcttaaggcagaagactgatgtcccagctcaaagacagtgcagcagaaaaacttctttcttaacccttcatcctagtcaagccgtccatgggttggatgaggcccactcacactcaggagggaaatctgcttcaatcagtttactgattcaaatgtcaatctcttccagaaacaccctcagagacacagtgagaaatcatgtctaaccaaacatctgggcactccctggcccagtcaaattgacacaaaaattaaccttcacaaatgctctcaatagaagtgattaataaatgtagcatcatgtactgcctgtttatcccgtgacaattaatatattccagcataacattggcttctgttcccttactgtaggaacacataggagtttcatttaaagtgaggataacttttaccttatggagtctctccctacccgtacctaccattgccacttgtggattgtcattttgccatggctttcttattcataatatcaataagctgtatactttgctaatgtaagtttgaatttcatcctggctgcataagtcactttccattttgacaaagcctagaaatatttttgtttatctcctgtatattggtaacacatacctattgtggggcccactctcaatctcatggttttctttattttcattcagctctcaatagatatgcctaggctgcttgaacatcactgaaaatggcctgtggccttgtccatctatcagagtccagtaaaatcctggccatggaatggggggatggaaagtgagaaccaccaaactcagcacacaaagactcagtttaaacctctgcgctaagagatgaccagactctatcatggctcctaatagcataagaccatgtcccatggatgaccctaggctcccatgacaatgcctacctaagaaagctcaaggctaccaggggaacttactttagttctagccaatacctgctgatgatggtaggttctttcttatagcatttactaagaagggaatccctcctccatccctttgagatatgtatgtatctcctagggactccagtgtgtctttccacaggatttgaaagccattccttttaggtgtagtcctcaggaaggacagaatctctgtcttccggtctctgtgggaggttaggatcctaacatctaatattgccagctggcagaaacagctgtcctgatgaggcagaagcttacaatgatcaatctttcataatgtttcacttgtgccctgaccctgccctctcccctgcctcactctctcattagaatgccatcacctctgcacaaacgggatggaattcagccccctctgctttggtcagtagttactgaataaaatctgttttcacagctttgactaatgtctgactttatctttgacaaaataagtgcaagcaattgttttgagcaacacagcagccacaaagagaggcacagacatgtcgggagagggaggaatcatctgacccttctcatttcacaggcatctattcctgcctggtgtttatgagcctgagacttggctgggctgccctggtgtatcactccatggctctggggcaagacttgagtaggctggtggtggcacttggtgtgaccacagccaccttcaaagatgccattaagggttcacaagaaaatgaaaggaaacatagagaaactgattttgaaagttgttgcctctcctgcttcctcattcagagtgtgtatgatattgctgtgtgatgttagttggactgcaatttagcacaacagctgttctaataattggcagtttctcatcgagttaagcctacctgaaagggaagcacacttacctttattgatcacccccgttaaatgaacaatacatccaacaaggcttctaccaaaaatgttcttattaacctcatttgtatactaaggaaaaactgggaacaacacaaaccttcatcaacagaagaatttaatacggactgttatatagtcataaaacgatcccagaagttcgctgcataacatcaaacccaggaacccacactgatgccactgatggcagaaaatcttgatacaaaaataagagagacgagagacagaaaatgtgctataaccatagtagtgggtaaaagccaaagagctcagtttctattcatgatattcgatagaagaacagaaggaacatgagccaatagctctaagggtccaggtctgcacaaggtgcctgttgggtgcagggttctgttggctccagtgttgtatctcaaatgggctaatttttatggacatagccactgcagaaatctatcaaagaataataaagggatagctatttgcatgttaatttaccattgtataggagggagaacgggccttagattggtttggtcaaataaaagcaaaaccgagatttatgaagaaaagaggaaaggggagaggaaaaaagtcatctgggaactttgtgattttgctccccttggataagcgacttgacagaaagctgtcaaagaggtcattgtgacccatcttctccatacccacatgacttggtcaccacagaaaacaattacagatgttggaggactttaaaacatcctagaagtttaacagctcatcctatgccacagaatatctgtgagtaatgtccaccatgtccttcggttgtacaccccctcagttaagccaggaggacgcctcttccctcagtggaatatcatacgtcgatgtgtagaaagttggttgtgccagcaagtaaatgacaaaagggacattgatagaattgggaaacacattggagtatgatttgctactgctcccacggaagataaatttgcagaatgtactcaaattagaagcattatataaatgctgtaatgtaaaaatggcacatcctgttctctacactatagaaatatctgcatgagtgaccaaagatatgtgtacaagaatggtggagattgcagcatcatttgtaatcctaaagtcatgaaacccacctcatttcaaaaacatcttgaaaagggttaaatcatgcacaaacagaggaagaaatgctgttttcacaaacaatggcgaggatcaccatgaggatgagtgattccactggtcacattattgatagagcaatcagtaaacccaggcacatcctgagaataggatactactgtaatagctctcctattactaaacatgaaaaactcgaggcactttactcccacaagccttccatgggagcaaagaacatttttatcacactagaagtgagttcctctctaaggtctctgggattcctgagtttgacagatacaaggcaccatgggccttgccaagcctcagccctagaagatggggaggaggacatgtgtgtctcctgattaggctggagttgattgtatatcaacagaaacaacaaaaatcaaatcatgaactatttttctatggggaagttttgttttgttttgttttgcgacagggtctcacttggtcgcccaggctggagtgtactggtgcaaacaaggctcactgcagcctcgacctcctggggccaagtgatattcttgcctcagcccccaagtagctgagacgacaggctaatttttgtattttttgtagagacaagatttcgacatgttgctgaggctcgtcgcgaaggggaagtaagttctttttaaaaagcatttattccgattgatttctccgcatcctgtggggcgcgcaaggggcaaggcctcccgtggcctctcttgccactctgaaccagggagctgtgggggctcagctgcgttgtttttgggtgcgtgtctggggcaggaggccggggccgggcaaggggtgaatccaacagggaactgcgaggaggagggcaaggaagtcggtagaggcatgcaccagggaaacttcccagtagctttgtgcagcgataaggactgcacaagggagagatgagaagtgttttcttattgtatcagaatggggaagaaaggggggaaaaacggagagacaccaagaaagaacgaaatctacgcggacccttgggtctccaaaagggaagcagtcctgcattaagtttaaagaaggagcgcggcgcgcttcagctcctgtggcttgccgtgatcttattgtggttagtactttacgcggtggccgcagcagcctgggctcgaatcccagtcgtggcaacgtccattctagggtgtagcgctcttctttccctttagcctctaacctcagcctaggctgcgctgttgacctgcggctagagaggtcacaactttcctgtgacttcggaactctctgtggtgtcgagaatagaaggaaaccctaccctgaatgcctaggggtccggttatcttgaaagacttttcctcctctctgagcaagtacaacacccaaaagatgaggtgccccctctcagtcagccttattggaatctttaatgttaacatgatgtggccgtacccgtttttctggctcagatatttcaaaaatccgtggggcctttttcaggccaaatcagaaatgaacaagagaagatgagagttcgcactccaactgggtattttaagcaaaacctaaagaatacaataaaatctaaagtttgtgactttctccaaccccaatttttaattttgtttttatttatttatttatttattttgctatcagtaaatgattgaagtataatccacagagaccaaagtgcaccaatcttaagtgtgtgagccagtgcattttgacaaaagaaaccatcacctatgtcaagttatggtacattttcaacagaccaagaagtcattagagcccctttccagtcaatcctcaccccatccccatttaggcaatcaccattctgacttctatctccgtgatttactcttgcttcttgtagaaatcacgtaaaggactacattgattttacctgttttcttttaatgcaacaatgatatgtgatgcttccattttatgacatgtatctcagctctttggtgttattgatgagtgttattccaacatgtgaatatactacagttgatggacaattgggctatttctagttttggctattgtgaataaggtgtttacaaatattctactatgggtctttttatggacctgtgccttcatttctattgagtataaatctagtaatggaatggctgggtcataaataggtgtatttttaactgtattagaaactatcagacagtattttagaatggtggcactattgtattttctctctctctctttttttttttttttttttttttgagacagagtctcgctttgtcacccaggttggagtgcaattgcaggatctccactcactacaacctccacctcacgggttcaagcaattctcctgcctcagcctcctcctgagtacttgggattacaggagtgcaccaccatgcctggctaatttttgtatttttagtagagacagggtttcaccatgttggccaggctggtctcgaaatcctgacctcatgatctgcccacctcagcctaccaaagtgctgggattacaggcgtgagccatcacacctggcctatatgcaaacttctgtatcagaatagaaaagttgagaagatagtacacagaatggagtaaagaggatggaatgggtttttggaaaccaattcacaatttaaagttgttttaacacccctaatccccaaagaaaaatgtatattctccaaagacatccctttcttaaaatatgcagagaaagtgtgggataaaagagcatgtagtaaacttctcagaacgtgtgtctggaagtggacaggggaatgggagtgggatgaacagagaaaagaaggaaagacagtaagggccttgctgagagcagccaccataatgtgccctgagctaaggtacatgattaccttcttcctgtgcacctgagatctaacagaatgtattgacttatcagggatatggaatttcaaaaacactacaggaaatcaaaaaatttaccaaaacagaacagtctagttaagaaaggcaggaagagattttataaacaaagcaaaaacacagaaatcatacagtgaggtggtgggaatgagactatgcgcatcgtctccaatataacactaattactgctaattataatggatttaagtatctcatattggatagaaaaggaaatgccagctctaatgctttaatggtggaaaagggttaaatattcaaagcagtgcacattattattgttagtagtagtagtagtattttgagatagagtctcactcttgccagactggagtgcagtggctcgatctcggctcactgcaacctctacctcctgtgttcaagcgattcttctgcctcaggctcctgagtagctgggactataggtcgcgcgccaccatgcccagctaatttttgtatttttagtagagattttagtagagatttcatatcggccaggctggtctcaaactcctgacctggtgacccacccgcctcgacctcccaaagtgctgagattacagatgtgaaccaccgcaccaggtcaaaagcagtgcacattatcattagcaagctagcccagaaagagaaaaccaaacaccgtgtgttctgacttataagttggagccgaatatgagaatgcttggatacataggtttcgggggtgaggacaacacacactggagcctgttggaaggtgggggttgggaggagggagagcatcaggaagagtagctaatggatgctgggcttagtacctgggtgatgggaaggtcagtgcagcaaaccaccatggcacacatttacctatgagacaaacctgcacatactgcacatgtacccctgaacttaaagtaaaagttggaaataaaaaattttttaaagtcaagaaaacaaacaacaaaaagagtagtgcaaatctgtaccatgctcatttgtaccactcttttgtttgtaccaccaaacaaaagaatgagagtgaaaacatgaatatctgacaaaagtaaacagcaaaagaacactttatgttaggagtaataccctagcatctacctagaatgaaatgaaactgtttttccctgaactggcctcccaagctgaactcttgggactgtgcctgggatgctccaggagaccagggtgataattgaacttccctcctcctacacctctatcgagttcctggaaaacgccagcgatcagatcttgcttttaacttcttatactttacagagacctaaacaagagggaagaaatggacatttcatgccaagatttcttcccttcacctcacactcgagttcctgggttctgacggccttttttgaggaaagtgctgatgtttgcgtcaaggttgggaggaaagggtttgggaggtaccaggcaatggggaggcaaagagaagacatcaacaagcgaggcaagaactttccacaggctgacactggatacaagaccagagacaaaaagctgggtgaatttctgatgttttcctacagaggttttttatccagttgcacacagcctactcagaataaggctttttcaagtcaacccttttaatgtgaagccataattttgtggtgttgcctgatgcaaatctccactgtgagcctttgctctgggtgtcttttttgttagtcacatcttccaaagagaacatggtgaaaatcttgactcctttccccaagtctgtgtcttaactgtttccaaggctgcagagctcgggggtcaggaggcattggcggtacagtggcagaattctcgcctcccacacgggagacctggattccatttccggcaaatgcagcgtcctgtctttgtgccctgtggttttcacatttacttactgtgccacgctaatgaagaaaaaaaaaggagcggggggtcgggggaaccactgtgtactcctcaggttctttccgtagcggaatttatttttcttttatttatttatttttgtttgtttgtttgtttgagacagagtctcggtctgtggcccagattggagtgcacttgcactatcctggctcactgcaacctccaccttccgggctcaagtgattctcatgcctcagcctcccaagtagctgggattacaggcacatgccaccatttcctgctaatttttgtatttttagtagagacggggtttcaccatgttggctaggctgatcttgaactactgacctcacatgatccatcagcctcggcctcccaaagtgctgggattacaggtgtgaactccgccccggagcggaatttacctaagcagagactctctttgaagcagcctgtgggtctggttggtctccgcgtttctacatatttggccctaaaaccggcacgacttttatcgtctctgttgttggatctctgcagtacaaagagtcacctggtcactgattctctgcctggaccttggatagaccattgggacacatcttgcgatggagtgcgactcaagcaatgacattcctgaaaggagagaagctgtggggttgggcggacacacgcaatgttggggaactgggacccagggagaggggagacgtgtgagaaggaacccacgtgcagatgaggggagctgcagagaggggcctcggaccttcctgttgaggaaagcccagtctttagtggtctcggcaaattaaaggattggccccgagtggagagcagcatatccccaaaactcatttctatcagccctgtttgttttacactgcaccaggcaaatcttctgtccacgggattctttttaatgcttctctttaagcagcgtggtggggaggccatggcgatcattagctctggaggcctggggaggacactctgaagaagaaagccctgcgattatccggtttcaccctgttttcatctactctttgcctcagcgaagtttatattgggtcctctatgttacatcacagctgctgcactggcggattaagagccgctgacaagtctctttcgggaaggggtaagaagcgcagctggcccagagccatggagagagacgcaagagcagaaccgaaaatactttcctccttcttgttctctctctgctattggtgaacatcaaccttccacacaaaccggttcaatactgccttggtctctacaggaggtttaccaatttttacagttcccgtaagccatgttttcttctcgtttctacagttcttccagggttgagtttcaggagctggtcagcagtccagactagttcaacatcctggttcaaaaccatttgtctcgtttcgctactagggtaaagcttgcctcctagaccagagttaagacgtgttccctcggcttctgttttctagagagaattggcatagtttcttccttaaatgtttggtagtgaaaccatctagacctggtgctttgttctggaaggttgttaattgttgcttcaattgcattaatagatagagacctatctaggttgtctatttctccttgtatgagttttggtcaactttatctttcaaggacttggtccaattcattgaagttatcaaatttgtgagcagagaattgtgcataatagtcctctactatccttttaatgtccacgagatctgtagtgagggtcattgttttctttttcatattagtaatttgtaccttttctcattgtttcttggctcaccagctaaaggtttatcaattttattggtcctttcaaagaacactctttaggttttgttgacatttttctaatgatttctggttttcaatttccttgatttctgctttagtgtttattgtttcttgtcttctactcactttggacttgatttgctcttgttttctttgagtttcctaaagtgcaagtttggattattgattttagatttttatttgtaatatttaatcttttaaaatccattattattttactttttgtacagtaattcttttagtgtaatataattttgttctggtaaaaatttcagttttattttatgtaccaagtgtacatgtataggattgttacatggatatattggacccaggtagttcacatagtacccaatagctagtttttcaacccactctccctccctccctccctacctcatggtagtccacagtgtctacggttcccaggtttatgtctgtgtgaactcaatatttaggttccgctcctaagtgagaacattcggtatttcattttctgattctgcattagtttcctccagagtatggcctcctcctctctccatgttattgcaaaagacatgatttcattctgttttatgggtgtatagtattccatgttgtatatataccacattttctttatttaatccaccactgatgggcatctagcttgattccatgtcttcgctattgtgaatagcctggtgataatcataggagtgcatgtgtctttttcttttaatgatttacatttctttgagtatatacccagtaacgagattactggttgaataacagctctgttgtaggttctttgagaaatctccaaactgctttccacagtgactgaactaatttacattcactccaagcatttataaactttctctccagagccttattagcatctgttggtttttgactttttaataatggccattctgagtgatgtgagatggtatctcattgtagctttgatttgcatttctctgattattagtgatgatgagcatttattcctgtgtttgctggctgcttggatgtcttcttttatgaagtgtctgttcatgtctctttgcccactttttaatgggattttttttcttgttgatttttttaaagttccttatagattttggacattagacctttgtcagattcacagtttgtgaatattttctcccattctgtcggtggtctgttgactctgttgatggtttcttttgctgtgcagaagctctttcattgaattaggtcttacttgtgaatttttgtctttgctacaattgcttttgtggacttggccgtaaattctttgccacggctgatgttgagaatgatatttcctaggttttcttctacggtttttctgctttgaggtcccagtatatattgtgtcattgcaaatgacaaccaaccagaaactaatcattacaagccaagaaagggaacttattggtgaccaggaaaaatgtccaacaaatgaaaattagtaaaagagattcctgggtgtctttttctgtaaagcctggggcattgttgtctgcagagttcacattttctgtaaagggccagggagataggaagtattgtaggcttctgagccaagaggcaaaattaaggatattatgtaggtgcacatataaccaggaagaaaacaaatttctaagccatttttattgatgagattctaaactaacaatagcaactgagtagaacttctcaggtggtaaatgttcgctgcattgagagcctaggctcagctttcctagaatccctggtacagccctccctttccaccccttaggctgtttcctccctgttttcctcagaagagttccatacaaaagacctactactctgagaaacagtgaagtactcctggggcccaccaaagcacacgagtcaagaagtggatggccttgtcccagctatggctcagatcacctttgcaggatgacatcttgttgggagattgtcatcagagccagggacatggaagatgctgtcagaaggatgaaaggactggtgcccagggggagaagtggccaagcaactctgcattcagcctcacaaaaatctcaaggggatgtagaaatgggaacagggcgaatggaaaactctttcaagcagggttttggggtcctgagctgatctctatttttcctcctacaacctgccgcacaggctattttctcacctctgtggatggaaactgcatccttccatatgctcagtccaaaaatctttgagttttctttgactgctgatctttccttcacaccctatagctgtttagtcaagaattcacattatgctgagcatcaggtgtgctccttaatccacaccatccttttcccccagtttataaaacttgtaaagtcattctcctgataaagacaataggatttccatgaaattgcacaatttttatccttcctggatacatgactcatgtaagagctctgctattgtttgctaccatttccccctatttttatttcatacctgtttgacctgcattctttcccataagccaggcacttcagctcaggtgtgctttcctaatcatagaattagcaatagcagccttgctaacaacttcttcctggccccaccaccaggcaaatgtcacaggatttaataggtaaagaatcgtaggatcgctgagcatggtggctcatgcctgtaatccaggtctttgggaggctgaggtgggtggatcacttgaggtcagagtttgagaccagcctgaccaacatggagaaaccccgtctctactaaaaatacaaaattagccaggcatggtgacgcatgcctgtaatcccagctacttgagaggctgaggcaggaatattgcttgaatctgcgaggcggaggttgcagtgagcctagattgcgccactgcactccagcctgggcaacaagaactaaactccatttcaaaaaaaaaaaaaaaaaaaagaatcataggatcgtgcctattactcggttttataaaatgaattgttttcccctgaattcatatgttgaaagcttaacccccaacttgactgtatttagagatagagtctttaaggaggtaattaaggttaattaggccatacagttggggtcctaatctggtcagaatggtgtccatataagaagaggaagggcatcaaagaatctgtctctttctccacacaggcacagaggaaaggctatgggagcacaaagcaagaaagtggacttctgcaagccaggaagaaaggcctccccagaaaccaactctgtgagcacatcgatctttgacttttggcctccagaatattgagaaaataaaagtctgttgttaaaccacccaacctatggtatctttctatggcagcctgagctgactaatacccttggtaggtgggtggcagtcaccttactgggctacatgatgtgaagttaaagtaactttagcaataggcaccatgtaatttcattgtatagatattatgtcttttgcactgatattgcttttttagttgtatgtatattgatgcctgggcctagcattacaagaccagtcaaaatgggaagaaagaaaagaaggtgggaaagataccaagttccataattgcatcctctacccacatccagttcttagaatcttttctgctggaggctgcaccttgtgtacactcaaattcaatctgagcacacaatcatttaaacaaccaaggcaacttttccaattttcagcatcacgcgcttgaggaaacaagtatttcatcactaatttaatattcattgagataattgttctcaggttgatgaaaaatgtggtgtatccatttactgttgtcttcttctgggtgaagaatgttgcctttactctctagctcacatttgaccagaaactggagtcccagcaaatcttagtagccacttaggaagcctattttaagatattcccaatctcaaacttgttctaagactagtatgcttattgaggagaaagagcttcatgacaaaaattcaactagagctgtgggtgacagttgtgtgtttcagtgctggtctgggcccaggtttcccatgagcacctaatgaataggctcatttgcagagatcgtcaaggtgttcactatgtctctctcacagcctcaaaagaagtgatcggctaaaagaatttgtgtagtatcctgaagggaaattagtccagaaatagaggacaagataaggattttataaaacagacatgtgattcaacagttgtttaagatgtagaaagctgcaagagacagttgttcccactctaatgacaagaaaaagctgtatggtctgcaaaatcatatgtgttttgatcccaccagagagctgaagttgcaaggcccctgagtcagctgaagtccaaagcatgagaaacccccctacagaaggacaaacagatgaagcagttcatctttaacagataatggaaggaaaagatggaagccataaatgttggttggagaaaaatcactgaagttttcatcatttctttagttttttttttttttttttttgatacggagtctcactgttgcccaggctggagtgcagtggcgcgatcttggctcactgcaggctgcaccccccggggttcacgccattctcctgcttcagcctccctagtagctgggactacaggtacccgccaccccgcccggctaattttttgtatttttagtagagacgcggtttcaccgtgttagccaggatggtctcgatctcctgacctcgtgaaccacccgcctcagcctcccaaagtgctgggattacaggcttcatcatttcttaaaggccaagtgtgaactattgtgacagcttagaatctctgagagtcccagacacatagcctgttttgcccatttactgggtctttcctcccacgtacttagtgctgataagacacatgtagcagggaaagagaatttctcgagcttgccacagtggtgtaggcatataagtcatgaatgcatgatagagcaccaccagagcacaggcacaaaacgtggttgcttctctcacataaaacaaaaggcatctaccactgatgttggagctagaaacctgtccaacccttgcccccaggtataggccagctgctgaggcagagttagacacaaaagctgtctatactggacaaggggaggagacctgctcttgcccaagacttcccatcattgaaaggtagagttccaccactcccaggggatgtcataggaacactaggactcaggcacccatggcctgaggtttggtacacattcagtgctatcagtaatatgagttggtttcaatcgatcatttgagttggttgcagaccctttcctttagtgaggaaaaactgtgatgtgggtacaaagtttccacgtttaggaaagattggcccgtccttcaggatattatattgattggatttctctcaacctcctttagttgtgtttaccgttattaaaattcagtgacattcacttggatgaggtggtaataaaaacaagttgtgagaatttctagtgatttttgatcccaagccatgtatcactgttgggccttcatgtgtgtacttgaaaacaaaacatgtacaattgtcgcactggtttgaagattttaatggtgaaagcaacctaatcagtaatcagtactctatctagaaaccaatcttggaaatatgtgattatgctcttttaaaatagctgaaaagaaggccgggtgttctggctcattcctacaatcccagcactttgaggggccgagttgggcagatcactgaaggccaggagttcaaggccagaagcctggccaagatgatgaaaccctgtctttactaaaaacacaaaaatcagctgggggtggtggtgcacacctgtaattccagttactcaggaggctgaggcaggaaaatcccttgaacatgggactcgaaggtggaggttgcagtcagctgagatcctgctactgtaccccaacctaggtgacagagggagattctgtctcaaaataaataaataaataaaatagctgaaaagaaatgactctgtgtttattctcactttgttcttgttttgttgtatagtatttaaataaaagcagattatttatcctcatactgaatttccaaaactgatatttgcatttaacattttgttaaatgatggagagaaaatttaattgtcttactttgaaaagtttggcataggttctgtcacatttttgatgctttcaatcgcagtctgtcattagaatgctggcaactagttacatgcaaggagtatcctaaccactttaatacaatggtttgaagtgctgcaggcagtaactactggacaccaaatcacagtgtttttattggtgacatgttagagagaaatagaactttctgcagtacaaatgtcctattaacaaatccttgtgctattagcttacaggactttgactcctgggtctgaaaaaggcacctactcctgctaaatcttgaatattgacaccattcaatgcctcatcttcagaccctgaggaagacgacaatccaaatgaactgctttcatgagaaacagaacaagaaattgaaacaatttaatctctctagacccaacaatcccacctgcccccttttccacctcatgccccctcttcctctggacagaagagatgggcacatgacaatggtaaggccggagtctgagggataagtttagttcagagactttcttttctttctcttttcttttctttccttccttccttcctttttcctttctttctttcttttttttttttttttttttgcatttttggtagacacaatgtttcaccatattgcccaggctagactcaaactcctaagttcaagtgatccacccaccctggcctctcaaattcagagattttctataaattagacattacactcaggagcacactgatgcaaggccagcaactggccccgtgtatcagaataacagggttttctagagcgttcatctgatttttcatagaaaagtataaaaggtcatgaaaggtttttgaaactcttaccttatggtcaaactaattgtaattaaatttgtgtataaggttttattaaaattatctttaacattttaatacaccacacaaaggtaaaatttagttttctcttttgatcaaaatgtttgtgtaatattaataatagataaaatatttttgtttaccttttggctaaatgattgactattataaggtgacctgtgaccctattttgtgatatcaagtgtctcaaaactttgatatctggcaaactttctaagagtaaaatttctaaattcagccctttggacctcaaattaactttttggatattaggttcttgaagtccaagagagatatattaggcttcttaggcttatttgttatgtagaattatgcatgaagcattgtcaaatctgaggtggtgtttcacttcctttgggttctattgacacagatgtgttgttaatgtgtgttccaggattgtatgagattcctagagttctgatatgctgttggtaataattatgattattacgttaaattgttgtgtgccacagaaccaaccaaattcccttgtcaactgtatctttaactatggctgtcttaaggcttttgtcatccacaattgttgttttgctttgattcttctcaaaaagtgacttataatcagtcacagtccaggccttggttttttggggaagtccatgaaaaggactcttggatgcaggtttctgataactctggagatcgtgccattaactaaagagaaaatttccagggcactaacagaaaggctgatgtgttcatagagattgctagcccagtatgaagcaaagcaggagatgattgcatggattaaactaatggaggactgaaataagtttttatggcctttgtttgtttgtttgtttgaaacatggtttattcttcagagtctggagaacttttttccttttgagctatttatagcctgaaacaattgagtagaatagtcttctaaacagaatttgaggcatatttttctctctctgctgaatttctccagaatttgtaaactgaatattcttaattcatgacaatgtgtttatttgcataagttcaataagattctgttttcttttataacctgacacaggtggaggaattggtaattttcccagggctttgcctgaaatgtcattgtgaaatgttccagcaaagcccatttaggagagcctatgtgaacaatgattcttgctgcactttgtgtgggtaatcaggccaagtatatgggactgaagcttcttttgcaggtaggttggtcctgctgtgttttatcttagtggaaatggggaactggagagaggaaggttgtgtttcaggagaaaccatggtattagatgaatgtttgattcctgggtggccatgcggtcacccatggtgtggagctgcccaggatgccccttctccacatgacacagccagaaagatggatgaccagattccccatgattgaggaactgacaaatagaaagtggggactgaaatcgatgcaatagtcccacagacagtgtttttggatagatgtagaaatggacccttctagtcttaaagcttgaaacttacatttgttttatctgagttcattcctcaggaaaggaccctcagcctctcaaaaagcatcatagacctgaaactcagcagatcacagcatccagacaatgagatgccagacccctcactcatcataagtgcttcctcacccctccagttcctcttttcctactcacagttacgtttcttccctgctacataaactcctcactttagttgatcagggagattgatttgagactgatctcccgtctcctcagctgcagcacacagttaaagccttcttccttggcaatactcaatgtctcaatgattggctttctgtgagctgagccgcgggcctagaccaaacacctgggctttcagtaacaatacatgtacacttttaaagcctgcaattaatgggtcatgagatattgagaaattggaatgacatcaacttggccaattctgagaaaatacactgtgcttaaatgtcagggccccgcctcctgaccttgacagtatatggttgattttgagtcatagcaggtgagtatggcctggtttgagtgttttatagaaatatataatatggctgattgcatttattttaaatccaaaaaatttccatttctggtgagcaaattttgttaaaaccaaccaaacaaacaaacatagaagtatatgaacaagacaatgaatgattccctgcctcccaatctcatttgattgctgtcttctgttatatactacagggaagaagggggcaaggcacccaggatgtcccatgtcctgttttgacaatcatctggcctccttgggcaaacagaaaagaaggaaagcatcaagaaaataacagaaattttgcagaaatttcatctccggtctgggcgcagtggctcacacctgtaatcccagcactttgggaggccaaggtgggcaaatcacttgaggtcaagagttcaataccagcctggccaacatggcaaaacctcatctctactaaatatacaaaatttaaccaggcatggtggcccacgcttgtaatcccagctactggggattacaatcacttgaacccagcagatggaggtggcagtgaggagagatcacccactgccactgcactgcactccagcctgagcaacagaaggaaactctgtctcaatggaaagaaagaaagaaagaaagaaagaaagaaagaaagaaagaaagaaagaaagaaagaaaggaaggaaggaagggaaggaaggaagaaaagaaagaaagaaagaaagaaagaaagaaagaaagaaagaaagaaagaaagaaagaaagaaggaaggaaggaaagaaagaaagggagagagagagagaaaagaaaagaaaagaggaagaaacgaagaaaggaagaaagaaatttcacctaggcacaggaaactctatgacagaggcttcaggggctcttctctggccctaaactcgcagtggatttttgcctcattttccgaggtgcaaatgaaatgatagaagtcgatcaaaggagagggcagagagaaagcaagaaggatggctccttcctgcaggtccaccttcctggagtgttgcttgtgggataatagaaatgccttgacatgggtgggtgggaactattgctacttattaggaattcagacgcttctggcaaattcgcattgtgaggttccatggtgtaatggtaagcactctggactctgaatccagcgatccgagttcgagtctcggtggaacctttctgtttaattaggaaggcaatgccgtgttttactccctaaatggaatggggattctgctgacgttcagaagctctgcgctgcgggcctccgtgtcccttctgctcccgctgtctgagcctcgggatgcacgccgctctcctcatcccctcttcggtgttcggggtcccagaaaccgggttctcacagtggcccggaccacagggaaatcgccgaatcatccattcggggtcaaagagcctggaggatcccctttcagggccagcctcctggcacccagcaatcggaggcccggactcgccccgccagggacccagcgacccagcaagtcctcaccccctctcagggcgaccctaggcctcggggagaggtttccactaaaaaggctgccacctctcgatcctagaccccgagattcctttcacccgggaaatctcttaatcgcatcctttgtcattttggtaagtaaacggtggcgtgagaaattttgatggggttagctcagtcactggagattgtgtctcagtttaggatcggtggttggagacctaacttgggagtagcacttttttattcgcatggcccatccaattccgaatgttaatttattctgttcttcatattcagatttttatgccgaatttctagctcctacgtctctattgcgggccctaaaagtcgctgtttcactaagctttggaacctgactccgggaaatttcattctttcctcccaagatctcagccggaaagagagatccgcgcgggctgggagcgcgggttctgttcctcggccgccccggctgaactcccgcaggaccacggggaagaggagcctgagcagctctgaggggccagtctctgacggtggggctccccctcgtcccgtcaggaccctgccccaaggagaagacgccttagaacgctaccagagttaaaaatgttttctcctgcgcttcagagcacttgggatgaggttcctgatgggtcttgggagtgaactaagatgtcactccaggcgctcaggaccatcgctctgattttcatattttggggctgagagcggttacgaaggactgaaaaacaccgcagtctttgaggggctcagtttggaggacgagctgggggaggggggcggtgagaagacgccttcttggctccttggagtggactggcaggtaaggaaaaataaactccgtttccccttgcaggctacactgcagggcctgggatggacaattggacagtcaaagagtaacaatatttatgtagaggttggctgcatgcattaaaaattgttatccctacagataagtgtaggaagggaccacggcactgcggttcaccaccagctttgcagcatatgtaactatgaaaacagtgtatagtgcataaaaaattcattcctgttcacaaataattgatcacaaccagttacaggtttctttgttccttctccacttccactgcttcacttgactagccttacaggaaaaaaaaaaatcatttgtaaatatgatattgtttcagttgatcctcagcccgcccgttccccaccccctgaaagtagctggaataacaggtgtgctaatttttgtatttttagtagagacagggttacgccattttggccaggcagctctcgaacttaagaactcaggtgatccgcctgcctgggcctccctgaacctctctgctgggattacaggcatgagccaccccacttggccatcatttgtattttgaatttaaatattttgtagtcatcactcttcaaagattctgggttttgttgcatgtgcatgatgggattcaggacatgctactccaaagtataacatcttggggtattgaatattttatgctaaaggaatatgagtaaaccacagaagcaggaaggtcactgtcaccctccccctgcccttcttccctgaagtcgattgtaagactcttatgtgagaggtgccctctctgtacccagaggaaaggtgcatcctggagtgtgaagacacagggacacagagaagagcctgaacacagaggcctggccacattttccccagtttgttactgttagatcatacttttattgtcttatcatacttctccatgactatccattcttcaataaaactactgttaaaaaacaaataaacaaaaaactgaggtttagctgtttccatgggccttcattttctttggaaggcgctcctgtcacataaaacttacattaaacaaatacatatgttcttctcttattagtctgtgttttgctgtgagggtctcagcagtgaacctaggctgggtgaggaaaagtcatatttcctccccgacatgtacaaatgtcttccactgtaaagctataaaaattttattggggcagatgtgaagcaaaaaattgaatcattattcccctttggatgagttgaacagatgagctaataaactcccagttccccccagatagaaatacttctctagctcattccccgaagctccttgagggtcaaacttgttggagattgaggggccttcctgggatctcccagcccaggaggttgctgctggtgagaggattgctgcagtctccctgggagggtgcatggtcactggaaagtatcactgctataacttcaatacaaccggttttcatcacatctgctctttgtgcagtgttacaggcaaaatacaagagctaacatgcacatgagtaacacatgcacatcatcaactgtgcctgcaacccaaagtgctacatgtcacacacagttgatgagtgtgcgtatgtttactcatttagtccttacctcaggcagaggtcacgccatcaccttcatcttccatatgagaaaactgagatgcacaaagatgttaagtgacctgcccagggtcactcagccagcaaaggaggatttgaaagtgggaatttgaagtgaaggcagcctgtctccagaagacattctcagaaccactgtgtttatactgctcctaacaaaaccagccttgcaaaaattatgacagtgagaaaaacctgacataggaaaactatgactgtgaaagaaatctgacctaactgactgcatcttgcttctaacctctgagctgcccttgtccattcctgggcataggccaggctaactatgagaggagtttagttccaagtctaagtctgaaacagagatgattgcccattcctgagacaaaccccttcctttcttggggatcagacctccttagcaaagctaacagatcaggtacgagattggaaattatggctcaggagccatgcagccagaagccacatgattcctaagctccccaactgtgccttatataacagtattagtgtcaaacctaagatttgacagggtgttcaaggtatttttcagaccctgccttatgatggactagctggcacacccagaccggtaaactgtctcatcttgtcctgtggccctcacccagggactgactcagtgccataaacaagctctgacactgtgatttcatccccaacgcaaccaatcagctttgcccatttcctagccccctgcctgccaaactatccaaaaaaaaaaaaaaaaaaccctagtctccgaatttggggggaggcagatttgagtaataataaacccctgtcctggtccctcagctgcctttgcatttattaaattttttctctattgtagaaagcctgctgtgctcagctccattggcttttctgggcaaccagcaagataaacctagcaggcaattacactaataaaagaaaaacacaaatggtaagcatgcttgaaaagaaatgtaagtctgtatatttcttttgaagaaacacaaaaggaggaggaatgataagataggcaatacactgtcctaaatattttcatgattctcctgcctcccgcatttccttcttatcccaataactgctccccagaaaccttcaacttaaacatggtcctgccagaactgggtttgtccttccctttacattttcctctcacctgccccacaccccttccatatctaatctgtcctttcacttccaagtcattgagtttttccatttaaaaatatgaaagatacggaaagaagaagataaccagttatccatattagcaaagtactgttcacatatgtacatatttttcttccaaacaattttaaagttactctcatttaaaaaaaaattatacatgcttagcatagaccataccaccaatacagaaaaagtacagatacataaaatttctgatcacgttaagttcaaaataatttttgttaacattagggcaacactcattgagtcatgttcttctggtatatctacagagacagtgtatattttaggtagactggcccccgccccatgcacccataaaagaaaaaatagaacaataaagaaagctatatatatatatatatatatatatatatatatatatgagttatatattttatatatatatatccacatacatatatgcttttgtaaaattgagcttagactgtatttttattttacaaatattccatttaatagtgcatgaatttaactgaagacagagacagaaacacaaatgaaggaattcctgaactctcaatcacatttagagagacattttctaaaggaatcttctaaagctaaacgtacattaaattaagtagaaggcattatgatttgcagtggttttccttttttttgttttttgttttgttttgttttgttttgttttgttttttgagaccgagtcttctctgtcgcccaggctggagtgcagtggcacgatctcggctcactgcaacctctgcctcccaggttcaagcaattctcctgcctcagcctcccaagtagctgggactacaggtgtgcaccaccacatccagctaatttttgtatttttagtagagatggggtttcactatgttggctaggatggtctcgatctcttgccctcgcaatccgtctgcctcggcctcccaaagagctgggattacaggcgtaggccactgcacccggccttctttttcttttcttttctttttttttttttttagcatggcatcactcactctgtcacccagactggagtgtggtggcgccagctcagcttactgcaacttccacctcccaggttcaagagattctcctgccttagcctcccaagtagctgggattacaggcgcccgccaccacgcccagctaatttttttttttgtatttttagtagagatgaggtttcaccatgttggcccgctggtttcaaactccttacctcaggtgatccgcctgcctcagcctcccagagtgctaggattacaggcgtgagccaccgcacccagcctgcagcctgtagtggttttcttattactttttacaatcaaattgattaaggcattggttgaatatggtacaatgcatccatttcaagtttgatgacatgtctattactccaaaatgtccttttgtaccctttgtagtcagtcccctcgactccctgaacccagcaatcaatgatgtagtttctgtcactatacaggttagtttcacctgttctagaaattcagcttgatggcgccacagaggatgcactcttttcatcactcagcatgaggtttttgagattcaccaatgctatctcatgtttccataatttgtcccatcttcccctggaagaatatatcacaataggtccattcacctcttgatgcatatgaacggtttccagtttcgggactattgtaaacaaagctgctaagaacaagttctttttgtgaatatatgttttgtaaattccatttgtcattctttagtattaacttattttgtaaaaggatgtcaccttcacaagtgcaaaattcattcaaatgttttttgaaaaaagttgaggcctgaagcagcagtctacacaatttcctttcttatatttcataattaaggggaagaaactttatctgggatattatttcctatcagcaaatccttaatgtaagccacacacgatgctagctgtactattagactatcttctgtaatctgtgcaataactccaagaagtacttcatattattattttcctgtaacactttccaacttgaagcctagcaaattgaaggacctggcccaaggtcaaacagaaggcaaggggcagcgccaggactggaagaaggccttcccaaaggcagacagaagctcatgtctttgtcagaacctcggtatttctgatgcgcctggaagccaatatccaagccgttctcagccaccggattggtgggtccttttgctcagaaactcctcgatgaggaatcccaagcatacgttagtgatgacggtcccgaaacaagggacatttcttaaacattctaaaaacccttttgctcatcggtaacgcaatgaaagttgttttcggtcttgcttcatatattttatatttgagcaaggcaatgtccgctgttggggttagaagtaaatggctcgtcttcatcaaactagatcagtccgtaagaagtacggcttccactcgcagtgtcctgaacactcgctgggcgtcctgtgcgttctagccggttttctttggagccgcgggtttctgcaccgcgcccgggttgggatggcagaggcttctcgggacgtgcggatctatgagtgccgtccccagggtagccaccaggggacgccataggccttccttccgtggtcctctttgcctttttcgtttgggccaggtagtttctattgaccaggacattagagatcagaagtgggtggggtcagaaaacacaccctgggagaggctggcgaaatgcccagaacctccatcactaggcctggggttttcttctgtagtggaattcttgtgctcatgtagtgcagggacaaaaccaattagatacttctgggagttaaaaagagatgaatttacaatgccatttgagaaggggtattaaggaaacgtccgaatttgccagggtactgatgcgtgtctggtgcaaaacgcaggttgagagagagctaagtacttcctgtccatgaaggtgataagcgagggcctgaagagggacgggggaggacactggcgccagagatagaaagaggcggcttgggggtgggaagcatgggtcggggtgctatttagaaagttgcctggcaatggatgtgggatgtggaagcgagacatcaaacaagaagctgtcacttaaatgaaatctgaagaaagactagatatgtaaacggcaggagatagtggatccggctcctcataaaatttcccgctttatatttcagggaggatcgcagcgcattttcgccaagacaggtgagactgcggttctgacctgcgtgtctcgggatgaattgcgttagggcacctgggcgccggtagaccccttcccctccgcaaagtaagcgtgttatgtctacaacccaacgggaacactaagagccccaaaggccctgatttcttcccaaagaacagcgcccgtctgcgtagtttgtacctggctctaccaagtgagaacacattccccgctagcacagaaatcctacaaactcctgagggggctgcgcttagaagcagaggctgtgtaaaaggtgattgggggctagggaaaaacaagaagatttttacagagcgtgagaccccaagagaatggagactatggaccaatctctgcaaaaagcagcctcatgttgaaaggaaggagctgtgcggccttcgcgctacttagcttgtgttaaacaggaacacaacgcctgacgcttatttctccggcaggaacgacggcgacatgttacttcctgtttccctgccatccggctataagaataacacaccaccaccaagattatacagcaaaaaaaagcgagaagtagacctttgcataccaactgctttttgcactggaaaattcaggggaaagcgcgaacgcagtcccccactaccacaaattacgcagtcgagtttcccacagttggggaaatcgcagaggtcaacacatccggagtgcaatggataagcctcgctctggaaaaaccactttcatgatcatactatctcccctgccaggtaagtgtgagttcacacatctccgccctgcgacagctccatacgcctcaacctttacagacacggtcacttgccccgcgcacccgcacccccacccccaccccgccccatgccacccggagccctcctagccctgacacacagctgggactctcacgtccaaccagcggtcctggacttgctcccaaagcaggagaaatccttcgtgggaagcagcagcccctaagctgcctcatctacgtaggaatcgccctatccgtgatgtcaccgacagcgcctttcccggtccccatctgctcttccgcccgaccctccgccactcagccgaccaacccgctgcgggagccggcggaggaagtgaagtctacctctatctcctttccctcccttccccacccctggtctctcccaaagaagtaggttcttagcctgtgatgccaaggacccctttggcggccagctggagcctgggcgctcttctttgagtaatggcttttaatgcgcaaactagaaagtttaggattacaaagaaaaccggttcttttcacatacggttatccttgtgatgtaccattccgcttgacagtggaagtcgttcaatatcagagagaaacagtatctatgaaactagagaggctgctcagatgactgcaaaccagccatccttacttgttttatcactaggaatattataaagacggctgtccagtttcatcaatcttgtagggtttttttcaaatacagcaatgtacaaaaatgtgctgccccagcagagcacactggacactcaggcatggtgctggagtcgttttgccatctcttcactgccttctctagaccttagcgcttacctcatgttaacactttatatgctgcaaagacagaaacaaagtcatccaaatgtggcaaaaatattttggggaaattttatttcaggtatttaactgattacttttaatatgtaggcaacaacaccaaactctgacaatactccgcagacttattaatggtttccacccccgtctctgcaaatctatcaggcaagtttttcccgccctttactttcatataaactgagtcatacactgtgtagtgagttttggggggagtgttactgcccaacaggttcaccttgcctgctgcctagacagagccaattttttgacacaggggaattgcaataaagagttatttaaacagagctggctgtgtgggagaccagacttttatttttactcaaatcagcctcctcaagcattccgggaccagtttttaaggataatttggtggatgggggccagtgagttgggagttctgattggtcaggtcagagatgaaatcacagggagctgaagctgtcgtcttgtcctgggtcagttcatgtgtgggggacacaagaccagatgagccaggttatcagtctagctggtgccagctgatccactgagtgcagggtcggcaaaatacctcaagcactgatcttaggttttccaataatgatgtgatctccaggaacaatttggggaggtttagaatcttgcagccagaggctacatgactcctaaaccataatttctaatctcgtggctaatttgttagtcctgcaaatgcagtctagtccccaggcaggaaaggggatattatcatctttgtttcacagctaaaccataaactaagttcctcccaaagttattttggtctgagcccaggaatgaacaaggacagcttggatgttagaaacaagatggaatcagatcagatctctttcaccgtgataattgtcccagttctaatttttcaaaggcagtttcagaagcagaggcataggtttgacttctttcactcagtcttatgtctatgaatttttcaccttattcatatggttatttgtttctgtgtgtcttactttgtatgaatatacattaacttatttattcatttgactgttgttgaacatgttgacctaaaagaaagaggctgaagcacaaaacataatatagagtttacttgagccaacatgaagacagctgcctggaagactcacacccaaggaaccttggatctgagctccctttggcttttgtcacaagcaggtttttaaggtcaaaagcagggacagacagtaggctgatagaaaggtgcctgtcaggaattctcattggtttacagaaataacattgattggtgattggctttatgttgttaagttataggctatggggtatagtgtttggtgtggcattattaggataatttacagcgacttgaggcgatatcaagcagtttcaacagatgaatacatagctcaaaaggaaggaatggaaaggggtttctctctcgatttaacatctctctgggcctgatcatttgaaagggctcacattcctcagataaaaatttttttaagtcctcctctccctctccctcgtctccctctccctcctctccctctccccacggtctccctctccctctctttccacggtctccccctgatgccgagccaaagctggactgtactgctgccatctcggctcactgcaacctccctgcctgattctcctgcctcagcctgctgagtgcctgcgattgcaggcgcgcgccgccacgcctgactggttttcgtatttttttggtggagacggggtttcgctgtgttggccgggctggtctccagctcctaaccacgagtgatccgccagcctcggcctcccgaggtgccgggatggcagacggagtcgcgttcactcagtgctcaatggtgcccaggctggagtgcagtggcgtgatctcggctcgctacaacctccacttcccagctgcctgccttggccccgcaaagtgccgagattgcagcctctgcccggccgccaccccgtctgggaagtgaggagcgtctctgcctggccgcccatcgtctgggatgtgaggagcctctctgcctggctgcccagtctggaaagtgaggagtgtctctgcccggccgccatcccatctaggaagtgaggagcgtctctgccaggccgcccatcttctgcgatgtggggagcgcctctgccctgccgccccgtctgggatgtgaggagcgtctctgcccggccgccccgtctgagaagtgaggagaccctctgcctggcaaccgccccgtctgagaagtgaggagcccctccgcccagcagccacaccctctgagaagtgaggagcccctccgcccggcagccactccgtctgggaagtgaggagcgtctctgcctggcagccaccccgtctgggagggaggtgggggtcagccccccgcccggccagccgccccgtccggaagggaggtgggggggttagcccccctcccggccagccgccccatccgggagggagtttggggggtcatccctctgcccggccagctgcccgtccgggagggaggtgggggggtcagccccccacccggccagccgccccgtccgggaggtgaggggcgcctctgcccggccgcccctactgggaagtgaggagcccctctgcccggccagccgccccgtccaggaaggatgtgggggggtcagccccgggcccggccagccgccccatccgggaggtgaggggcgcctatgcctggccgcccctactgggacgtgaggagcccctctgcccggccagccgccccgtccaggagggaggtgggggggtcagaccccgcccggccagccgccccatccgggaggtgaggggcgcctctgcccggccgcccctactgggaagagaggagcccctctgcccggccagccgccccatccgggagggaggtgggagggtcagccccccacccggccagccgccccatccgggagggaggtggggaggtcagccccccgcccggccagccgccctgtccgggagggaggcgggggtgtcagccccccgcccggccagccgccccgtccgggaggtgaggggcgcctctgcccggccgcccctactgggaattgaggagcccctctgcccggccaccaccccgtctgggaggtgtactcaacagctcattgagaacgggccatgatgacaatggccgttttgtggaatagaaaggggggtaaggtggggaaaagattgagaaatcggatggttgccatgtctgtgtagaaagaggtagacatgggagacttttcattttgttctgtactaagaaaaattcttctgccttgggatcctgttgatctgtgaccttacccccaaccctgtgctctctgaaacatgtgctgtgtccactcagggttgaatggattaagggtggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttatctgctgaccttccctccactattgtcctgtgaccctgccaaatccccctctgcgagaaacacccaagaatgatcaataaaaaaaaaaaaaaaaaaaaattttaaaaatctttcttcttgaaagcattgatgatcaaaagctcagtcaaggtgtccctctttgccagaaaggctcattcccagatagtcctatcccaggcaggggacagggaaggaaaggagccacctcaccaaggaatttttaagaatgaccacaagtccaattgaaagggcattacagccagacacggtgactcacacctgtaatcccagaacttcaggaggccaaggtgggtggattgcttgagtcgaggagttcgagaccagcctgggcaatatggcgaaaccccatctccacaaaaaatacacaaattagccaggtgtagtggcacacaccttagtcccagctactcaggaggctgaggtgggaggattgcttgagcctggaagttcaaggctgcactgagctaagatcacaccactgcactccagcccaggtgacagagtgagactcagtctcaataaaaaaaaaaaaaaaaaaaaaaacagaaagaaaagaaagaaaaagggcatcatagaatggcaaaaaaaaaaaaaaaagagagagagagagagagagaggcctcagttaagtctatagctgttgtcacctgttgaatcatctctagtcttcagaataccatgaaattagttttctcagaagtaaaacgatgagaaatacataacaataatgacattgcacttcatcattccatgctcttagacatttatagggccatggatggtgatcttttcaagagacaaaaataaatgctggtgcagaacaggtaagtgcgctataatttgagtacatcagcttttgagcatttaaatcatgcatcagaaatttagagcaagagggcaggttggatcctgatagcaggagtgtttttcttttaactttccagtagcatcatggtgtttaccactgtcatttcagagtgacgtgacaattttttgtttgattttgtactttttatttttattataattactttttgagacagggactcactctgtctcccaggctggagttcagtgcaagatcacagctcagtacagccttgacctcttgacctccaaggctcaatggctcagcctcctaagcagctgggattacaggcacacaccaccacacccagcttatttatttattttttgagacagggtctcactctgttgtccaggctggagtgcagtggcatcatcagggttcactgcaggcttgaactcctgagctcaagtcatcctctcacctcatgctcctcagtagctggactacaggtgggcaccaccacacccagctaatttgtatatattttacagagtcagtgtttcaccattttgcccaggctagtctcaaacccctgggctccagtgatcctcctgccttggcctcccagagtgctgggattacaggccgttattttgacaatacgattatgatgggttaaactgagatgtgaggcaggaaggttagggtgagtcacatagattcgataagcaggttttgcttgatatgaccctgagttgcatcgtgagtgcaatcaggaggaatacaggtgaaatttagcacaggatgtaccaacgggccattatggccaaaagtggttggtggtttaaggtggcaaacccagcaccttgttaaatttcccacagtgcaatggtttgtgagattctgatcagagaattatccctccctgctataatcaaattaattagggacagtgaaacagaaatctgatcataggcattttgctatgtaggtatgtatatgtatatacacatacacgcaataggactagtgtgtcatatcttaagagaatacacatataggatgattttaccaaaaccaccaagagaggacccctacaacttaagggagccctagtggtgtattattccagtcaacagaaaaagagactcaggtgcagtgagcactggaactgtattgttgatacaggccagtatcttgggcaaaagcggactacaacagatgtcagctacttgccatctcggtcaggaagactgagttacctttaagtgaaaatctccactaacagatgtccactctggcagtgctgccttttacaaaagaaacatgaatccgtgtgtcaacgcccttaagtttactggcacagattgttcagtaatacctgttgtgagttgggtacattggcccatgcctgtggtcccaactatttggaagattgaggcagaaggatggcttaagcccaagagttcaaatctacagtgagtcatgattgtgccactgcattctggcttggggaacagagtgagatcccatctcaaaaaaataacataaaataataatacctgatgcggtcccttctaacagtcttgggaggagtattttatttgatgttgtttccagtaaacaacaacatctccaggttataggccaagatttttgatattttcatctcccaagaattcattatgaaaggaatcctgtgttaatgtagagtttttagtaagttttgtgagatcttagcagtaatggagaatgtcacctttgagaagtgcatattcataagtgtcttcacctaaccactgcatgggtcttcctgttattatttcaaagagagagagtgtggacattttccagaactagtgggagatccttggccaagaaaggttaaaaacttctgttagctttgcctatggagtttttattgtatcatcagtgcattccatcagcccagaggattaggagtgataggcacaatggaattgttgggacatagacaaaactgtacaaatggatccaattacctgaccgatgaagtgtgttccttggttgctatggaattcagatggcactctccatgaagaattaccttttctaatcacaatctactaacctactacttgggctgtggctcatcggcatggaaatgctcaccccagtgagcacatacaaattagcaccagaaggtatctgtaaccctcagatggagacagctggataaagtctaagtgctatgtctcaaagggtcctaaaggtaaaatgttcctgtgacccatgaagtggttttccagggttatgtttgggacagacagtatagcaaaaataaaccttttctactatcataggcaatgattttcaataccattgctttccccatgctaacattttgtctgaattccaataagtcagcttatgaagtactgtaaaaagggtgactgaagcctaaagggtggatcagtgtatcattgggcccataccatatgcctgtttctggaagaaacttgtttcctttatccttccagagatccctctcctgcttgggagctcccacttatgcttcttcttctgttttttttttttttttttttttttgagccagagtctcggtctgtcacccaggctgtagtgcagtggtgcaatctctgctcactgcaacctctgcctcccaggttcaagtgattctcatgcctctgcctcccaagtagcagggattataggcatgtgtcaccacaccggctaatttttgtatttttagtagagacagggtttcaccatgttggccaggctggtctcaaactcctgacctcaggtgatctgcccgcctcggcctcccaaagtgctgggattacaggcatgagccaccatgctcagcccacttgtacttctaaagaagtcttcaatgggtcataagtcagcaaggtcattttgagaagttctgtgtctgatgtcaccttcagagctgcattcttagctgcagcgtcagcaaaatggttgcccttgctctccggaatatctaattttgaatgaccaggaactcctttgatgatggccaaagattcaggttttcaaattgcttctaagaggtcagagacttactggtcatttttcatggcttgaactgatgaaatcagaaacctatgttgcttctaaagcattccaaaatcatcacctactccaaatgcacctctgctgccagtgtaaatgttaggctgaggtgagaggattgactgagcccaggagttcatttaggtccagcctggaaaacacagcgagacctcatctctagaaaaaaaacaaagaattagctgggcattgtggcacgcacctcagctacttgggaggctgaggtgggaggattgctagagctgagagattgaggctgtggtgggccatgatggagccactgcactctagcctgggtgacagagtgagaatctgtcacaaacaatcaataaataaatctcaaccgtttaaaatatcaatgacagatttgcttggccttttaagtgcattgctgaattctccaatctacatttttaggaacaacctggggaatggcaacatggaggtatttggccaaaatgcagaccctttcattgtctgcttcagtctgtttttaagaatcctctaaaggattattccaatttgcccttttcaaccatttaatggccctgccttcttaccccagcatgtgaattaattgataaagatcagaatgtccaggctcaaaagtttgggcaattaagtcaaattacctcccaaacactataggatcttggaggctgctttagaattagaaggggaaaatgtatttaaatttcaatcagggaaatcttttttttttttttttttttttgatatagagtcctgctctgtcacccaggctggagtgcaatggtgcaatcttggctcactgcaacctccatttcccaagttcaagtgattctcctgcctcagcatcctgagtagctgggattacagtcatgtgccaccatgaccggctaatttttgtatttttagtatagatggggtttcaccatgttgtccaggctggtcttgaactcctgaactcatgatctgcccacctagtcctcccaaactgctgggataacaggcgtgagccactgcacccggcccagggaagtcttttatgatattcttaattcacattttggtgaagcagtatacagaatggtaggctcccttcttcctgtggattttaccttgaaaggggctgtcagaacagaagtttcagggaagggaccagagccctggggactttccttaggtgatggtgatggaagaagaggcaaggcaggaaaggagggctcaggtaagggagactatgcaggtacaggggcaggagaagaaggagcagttgggggcgaaagagacaaagcctcctcaatatttctcagttcagaaaacatgtcagtttagctccttcagcttacttcctcactggagataattttctcagttcttttagaaatttctaggtataattggaagtaagtctcccatttaatttggttctaaaaccaaatttttccaattgtgcacactaataaattattttaagcatttcaaaatatccccattttcttcattctgcttatgatttttcctggttaggtgggtccagtttcttggatatttacaagagaatgcctcataagtgttatacataaacccagctgatgtttctaaaggtggttgtttcttcgcagtgtgctaaattttgaagcttgatttcccataattcaggagcttttcagatgaccaaggcctgcgatgtgttttgggtcacagtgtggtgcttatgaagtcactcctacagataacaccggagttgtgtattgctgtctcagtggttcccactgtttctaaccaccaggtggccacagagtgcatgtgctatgagggacccatcccacatatgccctcccagaagagcaggaaagggggttcataaagatgttcttctgatagggagtgccctatgaggccaccttcacatggtgagtaatgaccccgacacctctgcaacatccccgatcacttggagcacctgaatggatcagcgggagcagatcacttcttttcttcagggcaagggaacacacctccgtgcactttccagttaagaacaggaactagtcacaaatgaaaagctaagtccgaatgttcaaaacaacatgctacataaaacgaaaccaccagagcatacctgccaataccttggcccagatcttcctgctgaggaacagaggcagaaaaggcagaagctctctggggagctctttgcctgactgtgacccaaactttctgtcctgacgcagaggtggaaaaggcagttatttccccctgaaactcaaatctcttactcacagggtaaagacagaaaacctccgttctagaaagggagagctggaaaggacactcaagcaaactccaggccttcaaccaaagagtgggaaggtccagatttcaggaggattcaccacttactactgcccaactctttctctcagagtcagaactcaagggcttcagatctggccaggcacccagtccaggaggaatgtggtgtgatctgagagatgaaaatacatgcccccttagagactaaggcagactcgaaagttaaggaaacaaaagttagctacttgtccagggttcagggctcatctggcatggcaacttcctgaattcctatggctacaggaaaaaccacactcttgctaaactccttaacaatagaactagcaagcaaattgtcaaaaccttcccagcccttctcaactggatttacaacccagatcactagacctctgatgggacagaagagtggccttccattctctcctgataagcaactgcggatatcaagccagtttcagccatgttacagggactgcacacaaaccgacttggtgtccagcagttcaccttttgacataaaaagccaatttccaccttattttaatgctaaaatcccttcccaatgtgaagatggggtgcatgttacatatatgtttaccctttgcacatgagctcaatacccctcagaaatggcgtttctccaaacctgctgaatatgtataactccattgtgtgatacacaccctgtgaggcactaaaaccaaactgccctctctctctctctgaagagaaagcaccttttcaaagacacacaccagagactgtctcttcctggactgcaaactgatctcaccaatgaaattcttactactatgtagccaccctggaggcctttgagaggatagtcagatggtcagagatgagttgctctgaatcctgctcccagggccaaaaacgtcaacctagaaggaaggggcttaaacacaaaatatgatttaaagagtttatttgagccaatgtgaggatagttgcctggaaggctgagacccaagcaatcttggatatgggttctgtttggcctttgttacaagcaggtttgtaaagaccaaaaagggagacagggagttggctggtagaaagttgcttatcaggaactcccactggtttacagaaataacattgattagggattagctatacattgttcagctacagggagtgagagatggtgtccagtgcacgtgattaggttactttatagctaactgtggcaatagcaagcagtttcagtggatgaatacatagctcaaaagtagggaagtggccagtggcactggcccatgcctataattccaacactttgggaggccgaggtgggcagatcacctgaggttaggagtttgagaccagcctggccaacatgatgaaacactgtctctactaaatatacagaaaaaaaaaaaaaaaaaataggcaggcattgtggttcatgcctttagtcgcagcaactcaggaggctgtggcaggagaatcacttcaacccgactggaggaggttgcagtgggccaaaatcctgtcactgcactccagcctgggcaacagagtgagattccatctcaatacaataaattattttttaaaaaaatttaaaaagcagggaagtaggatgtggttggtgtttcattttaatgcctagctctaggcatggtaacttgaaagcgcccattttcctcacatgaaaaagttcttttctttcttttcttttctttttttttttttttttttggagacacactctcacttactgtgccacccatgctaaagtgaagtggcatgatctctgttcactgcaacctccacctccagggatcaagcgattctcatgcctcagcttcctgagtagctgggattagaggtgccagccaccatgcctggctaatttttgtattgtagtagagatggggtttcaccatgttggccaggctggtctcgaactcctgacctcagatgatccacccgcctcagcctcccaaagtgctgggattacaggtgtgagccaccatgcccagccaagaccattaatttaatctacagctaaatctattatattttcatgttacaaattcagcaagaaaagttttccctaatgaaacatcacatttaaagcataagtagttaaaaaaaaaaaaaaaagtaagagacagggtgttgctgtcatccaggggagagtgcactggtgcaaccacagctgacaaacctggaaattctgggctcaggctgtcctcccagctcagcctgaattttaactttttagatgtgacatcttgtcctgttgcccgggctggtctccaattccttgcctaaagcaatcctcccacctcagcctcctgatttgctgggattacaggtgtgagtcaaccagcctggcattgcaaaaaaaaaaaaaaaaaaaagtcaagaaattattcttattctttattttattttattttgagttgaggtcttactctgtcacccaggctagagtgcagtggtacaatgatagttcactgcagcctggatctcctgggctcaagtgatcctcctgcctcagcctcccaagcatctgggactacagacgtgagccactgtgctgactagtttttcttttaatcagctcattttttaaaatttgtagagacaggcgtctcaccatgttgcccaggctggtatcgaactcctggtttcaatccttcttccctcctcagctgcctaaagtgctaagactacaggtgtgagcaccacgccctgcttaattttcatattttaattttatatacgtaattattactgtccttaagataactggggcagtaatctccttaaagttttagagacttaatttatctgttcactccactggaagagtatgccaattggtttcataagaagatttatttataaatcagaaaaattctttccaccaaactaggggtcattcaaaagcaaataattgccttaagtaacatcatttaaggtgaaaacagatgcagtggtatctattaataatgcttctcagtgtgggaaacaaactgaaaaaatgaacatcattagatccttggaaaaccctcactgctgaaaatctgagtaattctgtgatacccttttgagtcttccaggacattctctttccggagcacataaaagtgagtaaatcatttttcatccattttcattaagagctgaacttccttgatgttctggagattattaaatttgatttgtggccaggcgcagtggcttatgcatgtaatcctagcactttgggaggccaaggtgggcagatcacttgagttcaggagtttgagaccagcctggccaacatggcaaaaacccatctctactaaaagtacaaaaattagccaggcatggtgttacatgtctgtaatcccagctactcaggaggctgatgcacaagagtcacttgaacccgggaggccaaggctgcagtgagccaagatcgtgccactgcactccagccttggtgacagagcgcgactctgtcttaagcaaaaaaaagtttttatttgtatagttgtgagaagtgcttatattgctgactccattgcttatttgtgatcatataaatctcttttcttctttctctagtgtgatttaaacttaatccttaaagaacatgtatttcagctggttagagttttttagctagtagaaacctgagtatatgaatcaaagaaaactgctccttacatgccacagacttagttttctttctttctttctttctttctttctttctttctttctttctttctttctttctttctttctttctgtactaagatttattttaggtatagtaatttgttaaagccaagagctcctatggaatgaagttagatgggaggggggcattgagtagtaaggtcatccttataatagagatgccactcttgcagatattgacagctattgggcccaaaaaattgtaaccaaatgttggaaagacaagatatgagcaacttctgattgctgcagtctcaaatatcaagaaataccgttatcctcaggacaatgaatacacaatcaaaaaagactcacagactagattagctgtcatgtatcatcaaacagggactggatccttgtcaaacaccacccaacagagattgtccccagaaattcacttcataacatcaaaaccagaaacccacattgatgccactgatggcagaaatcagtgatgcaaaaatgagagagagagaaagagagagagatagaggaaggatttgtccaattacaatgcttagtatataaaagcaaatgagatcaatttttgctcatgaacacagaagaactgagggaacaagagccaatagctctaaggatccaagtctgcaccaggggcctgcaggattctgttggctcccatgatgggtctcagatgggctaatttttatggacatagcctctgaaaaaaattagtcaagaaataatatacagacacttatctgcatgcccattctccattaatatagaagggaaactggcattagatggttttcatcaaataaaagtaaaatcaagatttataaataaaagaggaaagaggagaaaaaaatgtctgggaccattgtgattttgctccctttggataagtgacttggcagaaggctgtcaaagaggtcactgtgacctgtcttctctggaccaatgtgacttggtcaccacaggaaacaattacaggctgggcacagtggcttatgcctataataccaacactttgggaggctgaggtgggcggaccacttgagctcacgagttggagagcagcctgggcaacatgatgaaactctgtcttggagagcagcctgggcaacatgatgaaactctgtctgtacaaaaaatacaaaatttagccgggcatggtggtccatgctagtagtcccagctactcaggaggctgaggtgggaggatcccctgagcccagggaggtcgaggctgcagtgagccatgattacaccactgcactccagcctgggtgacagagtaagaccatgtctcaaaatacataaattaaatttgaaaaagaaacaaggccaggcacagtggctcatgcatataaccccagtactctgggaggccaagatgggagtatcacttgagctcaggagttcgagaccagcctgggcaacatagtgagacctcatctctaaaaactacatacatatatatattaataaatatgtataataaaatataatatataatcaaatatatacatattatacataatatataattgtatatatttactttcagataattataataaaatatgtatatattttattatatatacaataaaataaaaaagaaacaattacagatgttggaggagtttaaaatatctcagccaggtgcagtggttcaggctggtaatcccagcactttgggagactgaggcaagaggatcacttgagcccaggaggctgaggcttacagtaaactatgaccataccactgcactgcaacctgggcaacagaaaaagaccctatctcaaaaagtaaaatgtcttagaagtttagctgtccatcctatgcaactgaatacctgtgtgtgatgtccaccatgtcctcctgttgtacctcccccttacttaagccaggaaggcacttgtcccgttattagaatatcattggcacatggccaggcgtgctggctcatgactgtaataccagcatgttgggaggctggtcaggagtttgagaccagcctggccaacatgatgaaaccttgtctctactaaaaatacaaaaattagccaggtgtgatggtacaggcttgtaagctgagatcactacaatgcactccagcctgggcaacagagcaagactgtgtctcaaaaaaaaaaaaaaaaaaagaaagaaaataatattatgggcacatatatagaaagtttgttaagccgggtacggtggttcacacctgaaatcccagcactttgggaagccaaggcaggcgaatctcctgagcccagaagttggggttcctggggccaacttgggcaacattgcaagaccctatctaaaaaaaaaagaaagaaaaagaagtaggatttgatggtgcacatctgtagttctagctattctggaggatcactagagccggggtggcagggatgggcggtgagtttgcagtgagctgagatcacgccactgcactccatcctgggtgacagagcgacacgtagtctcaaaaaaaaagggagggggggggagaaaatctgttgtgtcggcaagtaaatgaagaaagggacgttattagagttgagaaataaattggaatatgatttggtacctttcccacagaagataagtttgctaaatgtgctgaaattagaagcattatataagacccggtgcagtggctcatgcttgtaatcctagcactttgggagacctcggaggtgcctgagcccaggagtttggggaccagcctgggcaatataatgaaatcctttctctacaaaaatacaaaagttagctaggcctttcggaagcgacaactgattgtgccacagagacacaaccctagtggcttaggactctgggaagatataatctcccccacttatctagtgatcgataatgcacgaacgctttaaaagctggagcaggcggctgggcacggtggctcacacctgtaatcccagaactttgggaggccgaggcgggcggatcacgaggtcagctgatcgagaccatcctcgccaacaaggtgaaccctccctctctactaaaatacaaaacattagccaggcagggtggcgtgcgcctgtattcccagctactcgggaggctgaggcaggggaatcgcctgaacctgggaggcagaggttgcagtgagccgagatcgccctactgcactccagcctggcgacagagcaagactctgtctcagaaaaaaaaaaaaaaaaaaatctggagcaggcttggagcagcagccgtccctcagtgggttctagccaccaacctttagattaacagccgaacgctctaaccgattgtgccacagagacacgtagtgtaccttcttctgggcgctataggaagggtgcactcaccaaacattccccaaccctcccatcctcagagcccaccagacagtaggactgtgcaaggccttggaaaaccggagagattacagcggtgaattgtgttggtctcgttggagacccgcaggttgggagattctggaaccaggacgaccttgcccctagcctgctttagaagcccccggaaacgccccggccccgacccggacctgagccacctgggggcctaagggaagctgaatgcccagtgggctcccgggatggctcttcccgttctttgcgcagccttcacccagtgagggagcctgtgcccaccctgcccagtcactttcgaggccgctgcggaacttccgctgccatcttccgatcctgtgtcccgcactgggacacagagcagggattgtggtgagggtggctcgtgggtcctctcgcggagagcagggtctggcacttaccagcgcgcacgactaggacttgttgaattaatccattgcccctttagcttttagtcctttgaagggccctgaaaatggaaatcatgaaatatttttccacggggaagttttgttttgcttttgagatagggtctcgcttggtcgcccaggctggagtgcagtggtgcaaacactgctcactgcagcttcgacctcccgggggccatcgtcgcctttagcttttagtctcttgaagaaccccaagaatagaaatcatgagatttttccatggggaagttattttttcaaagggtctattcacgttgatttctcagcatcccctggggcgggcaacgggcagggcctccagtgcacctttctgccgcggtggagccgcgggggctcagctgggcggtggtagggtcctgaggcagaagggcaggagcgggggaagggaaaagtaaaagcagggaaagaagccggggagcggtggaccagacatccagacctcccgaaggcctcttgcagaggcacaggctggatcttctggaggtgagaattgttttttgttgttgttgttgaagcagaatagggaggaactgaggggaaaattgagagagaacacggaatagctccaaacgcgaggacctataactcccaaacaataacatcttccagaagaactagacagaaaactaggcatctgggaaccctgaaatcccaggagaagtagcatcatcatgaccctctgtgttccttttggcaaaggacttgcttcgtttgtacaattgtttgtgtttgttaaataaataaaacccttttcatgtatctttgaaagtacattggctctattattttatggttacaaataatgctgcagtcatcattcttgtacacttctcattggccactggtgtatttctatagtgtagaggcctggagagcagttgctccagcatagtgtttacatggtttttatatcattccattttctttcctttcttggcttattatctataactgtttctttcatctggtccaccgctccctagcttcttttcctgcttttgctttttcagtgatggctttcgggtttccagaatacatcttcatcagtgccatcaagtgacattatacctccccttctggccattatgctagtgttgtcatgtaatttgattttagacatgttacaaaccccagaatccattattattgcttttgtttaatcggtcaaattattttaaaagatttatataataagaacatatatatttaactatgtacataccaatttccagtactctccatttctttatgtagatccagttttctgtctggtatccttatccttaggcctgggggactccttttgcatttcttgcagtgtgggttgctgagttctttcattttttgtatgtctttaaatgtcctcatttcagtcacattctggaaagatttttcatttcgacatagaattctaggaaaactttatttctttcagtactttaggatgttgccactttgtttttgtaaaactggcataaagtgggcttcctgtacttgttatacaatttttggaatgtgtatttaaattaaaaacattaaaatgggctggacgaggttgttcatgcctgtagtcccagcactttgggaggcgaacacaggaagatcaattgaggcccagagttggagaccagtgtgggcaagatagcaagaccctgtctctcatacacacacacacacacacacacacacacacacacacacacatacgtacatacattgtgaatgtcctagattcatcttaagttccaccaacagtgcacttaaagtaaaatgtgcccaacctgagggtcaaacctaactgctgatgtgcagtctgtgtttgtgagacattctcaacagcatttgctttccctagcatagcggttttcgtgttttcctcatacctgaatgtcttaagtgcaaaacctgtcagaaatcatttcctttgccaaaagattctaaaatactttttttttttttgagatcagctcactgcaacttccacttcccacgttcacaggattctcctgcctcagcctctggagtagctgggactacaggctgccgccaccatgcccggctaattcttttgtatttttagtagagatggggtttcactgtgttagccaggatggtctcggtctcctgacctcctgatccgcccgcctcagcctcccaaagtgctgggattacaggcgtgagccaccatgcatggccaaggtttgacttttatacactcttctgaaagggggggttggctagtttgaattgcgtcgcgggaatttgctggcgcaaaactcgctgggcaggctagagggcttacagaagcagaaagaaggcagttaatcaaactgacaggtcttgcaacgcaagcatagctggtgaccttgcagctgcactgaagggaagtcaggaacttacaaaaccagaaatggtaagggggaaagagaaggtagtaaaggcatttgttgttttttcctcttatccttatccgtgctaggggcggactgtgtagacagagtctctggaactcattccctggggctctgtcttttcagacagtgttatcaaggatctgctagggctctatctattgctggtcttggagtaagtcaagtactgtgaagctcagttatgcagttgagcttcacacattaggggaaacaacaagagaacagcacatctggagtgcaatggatgagcctcaaacttaggacgaatcactttggtaaccataggatttcccctgccagataagtggcagtccacatacctccgccctgccacagctccatatgcctcaccctttacacccacggttacttgccctgagaaccacccccgcctatccccaaccaccccaagcccttctagccctaacacacagctgggactctcacatccaccagcggtcctggacttgctcctacagcacggggaattctccctggcgaagcagcaaccctgtgctgcctcatctacacagaaatgccctatcggtgatgtcaccgacagtgcctttcccagtccccttctgttcttccgccccaccctctgccactcagccgaccaacacgctgccggagcaggcgggggaagtgacgtctgcctgtccctcctttccttcccgccttgtcctttggggaggtgcgccaagaccctgcatctagtctctcccaaagaggtgactacttaacctgtgccctgcggaggaaccttttggcggccagctggaagcctgtgcacccgtcttcaaataaaggcttttaattcgcagactagaacgtttaggattacaaagaaaactggttcctttcaaatctggttatgtttgtgaaatagcattccgcttaaaattggaagcccttcaatatcagggagaaatcatatctatgaaactagagaggcaaaccagccatccttactggttttaccagtagtagtgttataaagaaagttgtccaatttcatgaatcttgtaggtttggttttttgtttttcaaatacagtactgtacaaaaaggaagcggaatgtggttgcagtcttaatgtaatgcctctctgggcctgagaatttgaaaaggctcacactcctcataaaagttctcttcttcgccgggacggacagtggctcacgcctgtaatcccagcattttgggaggccgaggcgggtggatcacctgaggtcaggaattcgagacctgcctgactaacatggtgaaaccccgtctctactgcatgggaaatatttatgtatatgcaacaaaaggtatttgccaccacacatacatctccctgctcagctaaatatgtcatctaaagtgatgtgattatctagtacaaccttagccagtgaataaatagctttttattgagctgcaaaagaggctgcagtttcaacagcagtgtttttctttctttttctttcgaagacagtgtctggctctgtggcccaggctggagtgcagttgtgccagcacagctcactgcagcctcgaactcctgggcttaagtgatcctcctgcctcagccacagagtcactgggattacaggccagagccaccatgcctgattttcatcagcaatgtttcctgaggttacagaaagatttgtaatcctgggaggaaacagtcccctgaagcaaagtgttctcccccaaaaatgcaaagagctatcttcttgatagcgaggcagataattctcaggttttgccccacagaatctctatctaaaatagagcagtggtcatgactagtgaaaagtttgagggaactcacccaatgttgggtttcttcagaaatatatatatatttacataaatatatatttatatatatatataaatatatatccaaatatcctaaaagacactgcccttcatcattccatgctgttagacatttataggaccatggatggtgatctcctccagacaaaaataaatgctggtgcagaacaggtaagtgtactataatttgagtacatcagcttttgggcattttaaaccatgggtcagacatgttagagcaagggaccaggttgatagcaagagggagtgttttccttttaattttccaatagcaaagtgatgtttgccactgtcatttcagagtgatatgacaatttgttgttgttgcttggttttgtggggttttttgtttgtttgtttttgagacaaggtctcactgtcacccaggctggagtgtggtggcatgatcagggtttacttctgccttgatctcacgaattcaagcaaacctccttactaatcctcccaagtagctgggactacaggtgcgtgacaccacaccctggggtgtgaactgggatttgatgttttcagttggctccctaatggaataggttcctttactattctggaatacagattgtcattctcgtgtgcattatatttctactaccctgctaatttttttctttttttttttttctttttaagatggagtcttgctgtgttgcccaggctctattgcagtggcaggatctcagctcactgcaacatccacctcctgagttcaagtgattcttttgcttcagcctcctgagtagccacccggctaatttttgtatttttagtagagacagggtttcaccatgttggcaggccagtctctaactccttacctcaagtgatccacctgcctcggcctcccaaagtgctgggattacaggcatgagctaccacgcctggctctcaaaccattttgagtaagcaaagacagatatgtctggctttttagtacgttgctgaattagcctccaatctatatttttaggaaggacctggggaatggcaacatggagatatttggctaaaatgtgaacctttcatgttctgcttcagtctctttttgaaaatccttccaatttgccttttgcaaccagttagtggccttgccttcttcaccatcatgtgaattaattgataaagttcagaatatttgggctcaaagatttcaacagttaagtcaaattttctgccacaccctgtgggatcttggagcctgctttagaaacagaagagcgaaatgtatttaaatttagatcagggaagtcctttataatcttaattcacgttttggtgaagcggtatacacaatggtaggctcccctcttcctgtgggtttgggttttaccttgaaaggggctgtcagaacagaagtttcagggaaggggccagagctctggggactttcctcaggtgatggtaatggaagaagaggcaaggcaggacaggaaggctcaggtaagaaagactatgcaggtgcaggggcaggaggaaaaggagcagttggaggcgaaagagacaaagcctcctcaatatttctcaattcagaaaatgtcagtttacctccttcagcttatttcctcaatggaggcaattttctcagttcttttagaaatttagaaatttagaaatttctaggtctcattggaagtaagtctcccatttaatttgtctggttgtaaaaccaaatttctctcccttttttttttttttttttttttttttttgagacatggtctcactatgtcacccagactggagtgcagtagtgtgatctcagctcactgcacactgcactcactgcttgctgcatgacagccagtaagtccagggacaaggtgtaggggcagggaaggtgactttattccagagagccaccaaactgaagagatggtgaacaaatattctaaagaaccatcttaaattaatatgattttcaggctccttgtacgttagggaagggaggaagaaggaggtggttgaggtgaagaggtctgacaatgacagacttatgggctgcagtgagagccaaaggggatggtgaaaattctttgtcttttgtcaggtcacaatgctcttataaatcttcaacataacactgttacttgtgcatacaacctctttatcttttcaggagtcagtttggggaagggattatgatcatctgtgttttaaagttaaactgtaagctaaatccctcccatagatagctcgggaggggcctatctgcagaaataaggaaaagcagttggcctgaaagatatcaccacagggcaggaagggttaggagcaaaatgcagttagtcatgctaagcctccttttcattgctatgtatttaatttacttgaacacataattttaattttatatatatatatatatttttgagacagagtctcactctgtcacccaggctggagtgcagtggcatgatcttggctcactgcaacttctgcctccctggttcaagcaattctcctgactcagccttctgagtaactgggattacaggagcccacaaccacgcctggctaatttttgtatttttagtagagacagggtttcaccatgttggccaggctggtctcgaactcctgaccttgggctcccaaagtgctgggattacaggcatgagccactgcgcccagcctaactaagatcattaaaccattctaatttgtcaaaagagtcacactgatttttgaaaaataatgtaatgggctgggtgcagtggctcacgcctgtaatcccagcactttgggaagccgtagagggcagatcacaaggtcaggagtttgagaccagccggaccaacatggtgaaaccccgtgtctactaaaaatacaaaaattagccaggtgtggtagtgtgcgcctgtaatcccagctactcaggaggctgaggcaggagaatcacttgaacccgggaggcagaggttgcagtgagctgaaattgcaccactgcacttcagcctaggcaacagagtgagactccatctcaaaaataaaataaaataaaataaattaaaaaaataataacataatgaattttttcatgtctttatatattaaatatttacattatttaaattgttcaaaagcatcaaagattcctctctatcaacttcatttcatttattttattgtaccaaactatcaagaccattaatttaatctacagctaaatctattattttttcatgttagaaattccacaagaaaatttttccctaatgaaacctcacatttcaagcatcctaagtaggctgggcgaggtggctcacacctgtaatcccagtactttgggatgctgacaggtgcataacttgaggtcaggagtttgagaccagcctgggaaaaatggtgaaaccctgtctctactaaagctataaaaattagctgggcatggtggcatgcgcctgtaatcccagctactctagaggctgaggcagggaaatagcttcaacctgggaggcggagcttgcagtgagctaagatcgcactactgcactctagcctgggctacagagcaagactctgcctcaaaaataaataaataaataatcataagtagtaaaaaagtaaaatgaaataaaaaataaggcacagtgtcttgctctgttatccaggctagagtgcagcagggcaatcatagcagaccaacttggaacttctgggctcaggcaatcctcctggttcagcttgccttgcatttttttagagatggggtcttgccctgttgcccaggctggtctccaactgctggcctaaagcaatccttctgcctcagcctgttgagttgctgggagtacaggtgcaagacatgcagcctagcattgtagtaaaacaattttcaacaaattcttaattttctttctttttcttttctttttttttttttttttttttttttttttgagttgggcgtcttactctttcacccaggctgcagggcagtggtgcaataatagttcactgcagcctgcctcagtctccctagtagctgagattacagtcatgcattatcatgcccagccaactttaaaaaaattagctaatacttaaaaatttgtagagacaggggtttcactatgttgcccaggctggtcttcaactcctaacctcaattgattctccctcctcagcctcctaaagtgctgggattgcagccatgagccaccatacctggtttaattttcttattttaatcttatgtaagtgattattattgttcctaagataattggggcagtgactcctttaaaattttagagacctaatttatctattcacttcactgaaagagtatgccaatttgtttcatgagaaaataccctacattcataaagcaggaaaattccttccaccaaactagggggcattctaaagaaacaaattttgctaagtaacatcacttaaggtgaaaacagagacaatggtatctattaacaatgtttatcagtgaaggaaataaactgaaaatattaacatcattagatccttggagggccttcattgctgaaaaatctgagtaatattgtgatacccttttgagtccggcaggacattctctttccagggcatataacaatgggtgaataatttcttttcattcattttcattaagggctgaacttccttaatgttctggagattattaaatttgatttgtatagttgtgaaaagtgctcatattgctgattccattgcttatatgtgatcatataaatcttttctctcctttctgtagtgtggtttaaacttaatccttaaaggacgtgtatttgaatttttcagctggttagaaacctgaatataccaatcaaagaaaactgctccttacatgctacagatttagttttcttcttgtactaagatgtcttttagatatagtaaatttgttaaagccaagagctcctatggaatgaagttgaatgggaggggggatgtggagtagtaagatcacccttgtaacagagatgccactcttgcagattttgacaactattgggcccataaaacttttaccaaatattggaaagacaagatatgaacagcttattattgctgcagtctcaaatatcaagaaataccattattctcaggacaataaataggcaataaaaaagactcacagaccagattagctgtccaaacagggagtggatccttatcaacacaacccaacagagattgtccccagaaattcacttcataacatcaaaaccaaaaactcacactgatggcaaaaaataatgatgcaataatgagagagagacagagagagagagagagagagacctgtcctatagccatacttagtgggtaaaagccaaagagctcaatttctgctcatgatacttaatagaacagagggaacatgagccaatagctcagtgggttcagatacgcaccaagtgcctgttggatacaggattctactgtctccaataatatgtctcagatggactagtttttttgttttttgtctgttttgtttttgttttttattttttgtttttgagagagagtctccctctgtcgcccaggctggggtgcaacggcacgatctcggctcacggcaacctccgcctcccgggttcaagcgattctcctgcctcagcctcccaagtagttgggactacagacgcacaccaccacgtctggctattttttttgttttgttttgttttgttttgtatttttaacagagacagagtttcgccatgttcgtcaggctggtctcgaactcctgacctcagttgatcagaagtaggtgaggtcagaaaacataccctgggagaggctggcacaatgcccagatccgccatcgctaggcctggggttttcttctgtagtattcatgtagtgcagggacaaaaccaattagatacttctgggagttaaaaagagattaatttgccgggcgcggtgtctcacgcctgtaaccccagcactttgggagggttcacgaggtcaggagatcgagaccatcctggctaacgcggtgaaaccccgtctctactaaaaatacaaaaaattagccgggcgtggtggccggcgcctgtagtcccagctactggtaggaggctgaggcaggagaatggcgtgaacccgggagactgagcttgcagagagtcgagatcgtgccactgcactccagcctgagcgacagagcgagactccgtcaaaaaaaaaaaaaaaaaaaaaaaagatgaatttacagtgtcatttgagaaggggtattaaggaatttgccagggtactgacgcgtgtcagttgcaaactgcaggttgagagagagctaagtattttctgtccatgaaggtgataagcgagggcctgaagaaagaggaaggggggaggacactggcgccagaaataggaaagggctgcttgggggtgggaaggatgggtcggggtgctatctagaaagctgcctggcaatggctgtgggatgcggaagcgagacatcaaacaagaagctgtcgcttaaataaagtctgaagaaagactagatatgtaaacggcaggagatagtagggaaactggacccgtctcctcataaaacttcccgccttatatttcagggaggatcgcagcgcatttcggccaagacaggtgagactgcggttttgacctgcgggcctcgatgaattgcgttaggacacctgggctccgggagagccgttccactccgcaaagtaagcgtgttatgtctacaacccaacggggacgcgctaagagccctaaaggccctgctttcatcccaaagaacagcccccgcctgcgtagtttgtagccggctctatgaggtgagaacacattccccgctagcacagaaatcctacagactcctgagggggctgcagctagaagcagaggctgtgtgaaatgtgactgggggctagggaaaaacacgtagattttcacagaccctgagaacccaagagactgcagaccatgggcagacaaatctctgcaaaaagcagccccgcctagataaaggaagagctgtgcggccttcgcgctagctagcttgtgtaaaggtcgacgattcttatttctcccggggcggggagaaagcgacatattactactatttctcagccttcgactgtgagagtaacgattaagactaaaacacaagccagtaaaaaaaacaagtaacccttgctgtgtagactattctttaaactacaaaaaatcaggggaaagcgcgaacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgagctcttgcacctccgccccgccacagcctcacacgcttcaccctttacacacacggtcacttgccccgcgcagccccccccccccccccccccccagccctcctagccctgacacacagctgggactctcaggtccgaccagcggtcctgaacccgctcccacggcacgggaaatccttcgtggcgcagcagcaggtggggaagcagcagcccctgcgctgcctcatctacatagaagtcgccctatccgtgatgtcaccgacagtgcctttcccagtccccgtctgcctttctgccgctcagcctaccaacccgctgccggagccggcagggggaagtgatgtctgtctctcccttttttccctcccgccccggcatctgttctcgcccgaagaagctggtccttagcctgcgctgcggagcaacctttcagtggccacctggagcctgggcaccgttcttcaaataatggcttttaattctcagacgagaacgtttaggattacaaaagaaaccggttctcttcacatccttatccttgtcatgtagcattccgcttgaaattggaagccgttcaatgtcagagagaaaccatatttatgaaatgaaagaggcttctcagatgactgcaaaccagccttccttactggttttatcactggtaatgttataaagacagttgtccagtttcatgaatcttgtaggtttttgtttgtttatttgtttgcttttgatgttgttgttgttgctgttgttttccaaattcagtattgtagaaaaatatgctgccccagaagagatgattggacactctccagcgtggtgttggactttgtcatctcttgcacagccatctccagaccttagtgtttacctcacgttagttttttatattctgcaaagacaaaaccaaaataatccaaatttgacacaaatacctgggatacatcttatttgagatgtttaacaaatgtctggatcatcttttcttacattggattataacgcaggaaacactgtgaagtaagtaaagttggaattcccaagtcaaagaccatttgaatatttacaagtagatttgaggcaggaataatacagggtggccgcagggtaacaaattctaggcagcagatttacatgacttgaggctatgggctgataagacgctgaaaaaccagggtgtggaccaagctggctaagactgactggacccaatgtggtgctggatttgatgtaggttttaccgaggccctcattatatgctcattaacatactaaatcacacacccaccagtgccatgacagttctgagaccaatatgtgatgtaaaaatggatggcaccacagttccgagaaatctccacctttacccaggaattttcatgactattccactccttggttagagaaaccaatcaagatgaaaccccagaacccattgttctctctcgggtatgcccgaactcccctttcttgagtgtgtactttttgctttgcaataagtctcttctttcactgtttgctgactcatccttgactttgttcttgagatggtgtcaagagcctggacaccacagctggggtcgagatcccgctagtgtccggggactttccccaggccaccagtatcagattctattccattgctcaaatcacaaaacatcgagtggagagttctccttggagaccataaagtaaagattctgtggcatggtggccagttaggccactggaaggcatggcaaaatattgaaaatgagagattaggtgacagtgtagtaataactgctgaatactaaatatttgagccaggccccattccctggatactgacagggagacacattgtccaggtagtagtggagaaatactttctgggtatctgaccagcctttgtggaaagaactggcaccatcctgcagatgtaaccgcctgatgggttcttcctgcccactgtacatacaaaatcaattcatggagaccatggcattgaggtaaagagtttaattgacacaggccagccacgacatgtgggggacagagttattactcaaatagatctcactgaagacttggaggtaaagggttttcaaagacagtttggtggggagggggctagggtttgggcggtgctgattgttggggatgaaatcacaggggtgtggaaaatggccctcctgcattgagtcagcttctgggtgggagctaagggactggttgatttttgggccaaatggtgccatccagtagtcagaaatgcaaaagcctgaaaagacatctcaagaggccaatcttaggttctacaatagtgatgttcttcacagcagtaattggggaagctgcaaatattgtgacctctggaataatggctggtaattatttaacgaggcatacatcttagtagaattcaggcccctttcatcctcctaacttggtggcctttcattagttttatggggtaatttagttttggggaaggttatcattttaaccaacatttttggctgtccccaacctttttggcacctgggactggtttcacggaagacaatttttccatggaagggggtggtggatggtttctggatgaaactgttccacctcaggtcatcaggcattagttacagtctcataaggagtgcgcaatctggatccctcacatgtgcagttcccaatagggtccgagctcctatgagaatctaatgccgatgctgatctgacaagaggcggagctcaggtggtaatgctccaaagcctgcagctcacctcctgctgttcagctgggttcctaacaggccatggaccagtacctgtcttgtggccctgggggttggggacccctgatttaaactataaactcaatttttcccaaagatagcttgggagaaattgcacaggaacgagcaaagacagctagcctgtgaggctagaaccaagatggagtcagccatgtcagatttctctgattgtcataattttgcaaaggtagtttctgagggactaccctgacacttgttaaaagcatgaggtggattttattgtatgtactacagtaggcaagagagaccagcagagaaccgagctcaacctcaaatacagcaggaagagttgaagattatagccaattggcaagataagaaagtcagtggatggaaaattactaagaggaacttgattagctatcaaaggtggttgggaggactcttgctaaactagactcaacagtattcttttctaaaactggacttagcaggccaagaactaatagagaaaagggctcagaggaaactactaaggtttggtcaaagatggagtccttgtcaactctaaattgaagcttctgcaaataaacgaagaccaaccaaatgaaaaaaagcaaaagctatttattctgagcttgctatggcagggagtcagccactgttacttgtgttttggcagagacttgaaggcagtcagaagggtgagaaagctttttaaaaagaaaggcttcaggtatgcttggactggaggctgtcagtatggtgacgctgtagatagatgaagaaaataaaaatattttaccccagaatatatttctttggtatattttaagatggctgtcagagagccagcaaacagaagtaactctgcaaaactgtcttttgtaggggaaatttacacctgcagagaatctgcattaatccagccttcccttgtcaggattgagaaataaaaataagccctaggccctacaaccaactgaacagactccctcttggctgacaggaccacagagaaaccttgaaagctgtttctggctgtgacaggataggaggtcggacgtgcccccttaaaacccctccctcactaactgccattatgaggcaggagaatagcagagggaattggaagttggataaaaggcagaatgagtaaaggcagaaacagaagcaaggtgatggggcgggagagcaagaagcaaaataaaaggcagaagttgagcaacctaaacaaaaagtaagattaaaaaaagcaaggaagaccgggcacggtggctcacgcctgtaatcccagcattttgggaggccaaggcgggcagatcgcctgaggtcaggagtttgagatcagcctggccaacatggcgaaaccccatctctactaaaaatacaaaacattagctgggcatggtggtgcactcctgtactccaggctacttaggaggctgagacaggagcattgcttgaacccaggaggcagaggttgcagtgagctgagattgcaccactacactccagactgggcaacagagagagactctgtctcaaaaaaaaaaaatagcaagcaaggaccccattgctggcaagatccaaaccagtaaaggggcagctcctcagagacagacatgtgcattcaagaaaaaaagcatccttaacatgactccatatgataatcagctcattaaaactcatgcatatggactacatatcttgcatgtacttaaaattatggggtggagacaatgtgcaagcacacgagggccaaagtaactaagcaacccacccatcaatctaaaggcaaacactggctaaagattaggcatccttgggaagagaagaaaaaaaaacacacataaaaagacccaaagtacaccaaactaatactgatctcatctgccacaggtcagcccactctccccactccaagaatgttactgtgcttaataaacttttgctttgctttgctgctttgtgtgtgtcatgtacattcttcgtttgggacaccaagagcctggaactgcatggcaccatctggtaagaattaggatttttttttcctaagggttaacaaaccaactctttggaaagatttgcttcactactattatcaatcaacagcctgatactttccctcccttttgtggttttgacaaagcaagcaagcagcattccctcctgataagagaccaccgacctaggaatgattctggccagactacagaggatgtacagtgagagttttcatgtcttctgcttcagcttttgatgtcagagggccacaaactccactctcagatgattgctaatgccaccattttatgaacatgggccccatggagaggcacaaagctcaactgcacttctgcacatttttcctcttataaatattcatattggaatattatttggtactgcttccatgaaagacacatttgcagaatgtactcaaattagaagcattatataaacactataatgtagcagtggtgcatccagttctctcttttttttttttttttttttttgagacagagttttgctcttgttggcatgatttcagttcaccgcaacctctgcctccgggttcaactgattctcctgcctcagcctcccgagtagctgggattacaggcatgtgccaccacacccggctaattttgtatttttagtaaggatggggcttctccatgttggtcaggctggccttgaactcctgacctcaggtgatccgcccacctcggcctcccaaagtgctggaattataggcatgagccaccatgcccagcccccagttgtctatactatacaaatatctgcagtgtagacatttccacaatgaccaaagatatgtgtacaagaatggtgactgcagcattctttgtaatcctaaaaccaaaacaacttcatcccaaaaacattttttcttttttttttttttttgagatggagtcacactctgttgctcaggctggagtgtagtgatctcagctcactgcagcctccaccttccaagttcaaatgattctcctgcctcagcctcccaagtagctgggattacaggtgcatgccaccacgcctggctaaaacattttgaaaagggttaaataaatcatgcacaaactgaggaaaaatactgttttcaaaaatggtggagaggatcactatgatgatgaatgattccactggtcacattattaatagaacaatcagtaaatccaggcacatcctggagatagtactgaactcctattactaaaatatgaaaaaatggaggcacgtacattactcgtttaagcgcataagggactgaattagaatttatcacaccaaaagtgggttcctaggtatctgtttcaggatcctgagttacacaggtgtaaacccgccatttcaggagatacccggttaagaatcggatgggggaggggggctggcccttgacatggatcagtcataaattaggggtttggggctggcccttaacatggatcagtcataaattagtggcttggtactccgggaagataaaatcttccccatttgtctagtgattgacaatgcgtgaatgctttaaaagttgcaatcagcgtccctggatgggctcgaaccaccaacctttcggttaacagccgaacgcgctaacccattgcgccacagagacaagcactaccagttctaataggcaatataggaagggcacactcactaaacttcctccgtcccttctattctcagcgcccgcctggcaggacgactgagcaaggctttggaaaaccagagagattagagcggtgagttgcgctggtcacattggatacctgcgcgttaggagattctggagccagacggagagccgaatggccttcgcccgccctgcccctctcttgcttcagaagcccccagaaactccgcggtcggcgacccagcccgagccgcctgaggtcccaaggggaagctgaacgcctggtgggctcccgggatggttcttcccgttctttgtgccgccttcacccagtgaaggagcctgtatccaccctgctcagtcgcttttgggctgctgcggagcttccgctgccatcttcggatcctgtgttccccaccggggctccaccagggcagggatggtggtgagggtcgctcctgggtcccctcgcggggagcagggtctggcactcactaaggcgcacgactaggacttgtcgaatgaatccatcgtctcctttagcttttaatcctttaaagagcactgagagtggaaatcaagagattttttccatggggaagttctttttacaaagcattgatttctcggcaccccgcggggcgtgcaactggcagggcctctggtgggctttctgccgggtggagctgcgggggctcagctgggcgggggtcggttcctggggccgtagggtgggagcgggggaagggaaaagcaaaagctgggaaagaagccagggagacatgaaccagacatccagacctcctgaaaggctcgtgcagacgcacaggcgggatcttctggaagtgagaattgtttttgtttatctattgtagcagaatggggaaatggagagagaacctgaaagagccccaaactcgaggacctattgctccccaagaataacatcttccagaactagacagaaactaagcgtctggaaaccctgaaatccttggaggagtagcatcatcctgaccctctgtgctccttttggcaaaggacttgcttccattgtttgtttgttcaattgtctgtttgttaaataaataaaactcttttcatatatctttaaaagtacgttggttctattattttatgattacaaacaatgctgcagtcatcattcttctacacttgtcattggccactggtatatttccatagggtggaggcctggagagcagttgttccagcatagtgcttacatagattttatttcattccgttttctttcctttgttgctttattagctataacccttttcttatttcagtggctgctttagggtttctgggatatgtctttaatttatcacagtctgctttcaggtgtcattatgtctccctttctggcctttatcctagtgttatgtaattttactttatacattataatccttgtgattcattattattacttttatttattacaccaaatattttttaaaagatttaaattctaagaaaatgtgtagtacatgctttctaaatgccatttccagtattcgtttctttgtataggcccacatttttatctggtatccttttgcctctgcctggaggacttttaataagatttcttgtaacgtgggttggtgaattgttttagcttttgtatgtttttcgatgtccttatttcactcacagttttgaaattttatttttgcatagaattccaggttaactttttttctctgggtactttaaaaatgttaccatttatgaagcattgccattataatatcatctttctttcctgtgtttgtaagaatggcataaagccggtttcttgcggtggttatataattttcagaatgtgtacttaaatttaaaatattaaattttactaaaatactaaaaatattaatcatgaacatcctagattcatcttaaattccaccaacagtgcacttaaaatgtgcccaacctgagggtcaaacctacctgctgacgtgtaatttgtgtttgtgagacattctcaacagcatttgctttccctagctgagtgattttcctcacatctgaatgtcttcagtacaaaaggaaacctttgtctttgcaaaaatactttcaaatattcttacttcaagtaagtgcattaaaaacaaacttctcagttgcatccctggaatccgtggaaagcccgggagagacagtcaagtggttcaggatcaagagctaaacaagggaagacaaagcgtggcttcttcactaggagtccagccaaagtcaactgatttggtctccagtggaggtcggaactcggttcaccagcgacgtgaggacccggcccagaggaggcggactttctcttcctggtgccttcagataggaaatctagaatttctttctttccctttgatctacttctaactctcccgttctatttcttcaagacctttttcggatccctactgcgaaggacctaaggggccgatgcccttccctaacggtccctccctggctgagtgtcttcggagcccaagctcacctgtaaggttactgccctccggagacagcgagaggaccaaggagggcggcgggtgcggtgggaaccacagagtcaccgcgcacctgcgcctcgcgggctcctagcaaattgaataaatgatccctgaagcttctctgcaggtcacagggaaggggagggtaggggtcgacccgcggaagaagcttcaagaagcatcgggaggacctggccctgcctctgggccttgaaaacaggcctggccaggctgattttgtcgcgtaggcccaaagaaaagtgtcaagggcggcccaaaccctgacctcgagattaaggctcttaaatgtctgacggttttgagactcgtctgtagaatcgatcccgcctgtatccggagaccggagactcctttgccaaaattcagagaccaagaaagagaaagattgggcagatcaaagtctgtaattaacccaaacaggaaacgtaatttttctgacaaattgtatgtgtgctctgagaaaaagactagcctcaaggagaatctgtttttttggcttgagtgtagggaagaatggaattgccaccaacaatgttgcgttgaaacggcaggtgcatcaggctgtagatgtgaaggaattaaaaatatttcaccccaaaatacatttctttgacacattttgagatgtctgttcagaaagccagctgcagaagtagccctgcaaagttgtattttgttggggagatttgcatctgtagggaatctgcattgatgcagccaagtctttctttgcccagatctaggaaagattaactgagagtctgacagctgtaaaggtctcaaagaaacttttagggtttactgtctctgagagctgctacctgtaaggtttcatttacatattaagaccacctttgctagctaagcctcctcttctctccctcctataacctgtcttgcccacaataaatggatatacatctgactctgatggtacctggttttggccatgctttgagccctcattcattctgttacctcgagatggtgtataagcttctgcatcccattgtgggtagggtagggtaatcactctgtggccctccccatgtacatgttagtacattttatgccttttctccaattaatctgccttttgtgagttgatttttgagtgaaacttcagagggttaagagggagggtttccattggcccctacagttttggagctgtaagcaggatagtaaagctctgctcttctggaagctgcagtgaagaacccaggatctgatcagctgtcataagggtaagaattttttaccagccaggctcccagcctccttctctgtgtggaatctgatcaagtgcacagtaaaaatcactgcttcttttccctctccaaaatcttgattaatgggagaaaaggatttgtgtgactagtcttgggtgtagtgactctggtgtgcttttttggtactttgtggtaccaattcatattgtttaatccctttcttcccagaaaatgtctgttcctttgtctttgtctctacgtgttattctgtcataaaagggggtactggttgaggttccttcttatcttattttatgtccttgagagcttgacttgtgacaaagtgggagcactttctcttggtttccgctatcgggtaagaggtggtaattttcaggtcatattaggtggcctgtctgaaaatggctggaaacccgagtacactttttgttctaactatgtcaagctcttggggtttgtcttaagaagtcccatcccttcgaggcttttgccgtctcaactcttgttgcctgattagtcctagaaaagctcagtcccaagagggcctacctggtatcacagattcacaggtctgtgactggaagcctccacaaatttgtgggttactggaggcaatcatcatccttaactatctgtggcctactccttacattgaacttttttcttggaggggagtctttgggattgcctcttctatgcccttcccaggaagttaacctggaaaatgacatcctgggctttccacaaagaggctatttggttgaattgctattggaataattataccattggatattctagttgccaatggcctgaagatggatcccttaaattagacacctgaattaaaaaaaaaaaattagagatctcttatttgaaacagttgataggaagatcaaattaaaagaaagacacatactagtgtgatagctacccttaaaaattctcttgacaatattatctgtcttgtatagggaaaaaattctcttgactaaattaaagagcaaaatttgatccaaaacaaagttaaaattcttcataagctcaaactgcctgctctggatcccttccaggattcacaataaagtctgctctaccttgcagtttagtacttaaagttctgtgcttttgctgccatagcctgggttcaatttccagtcagggaaccagtttattttggcttgatatttgtgtgacttttgactttttggaatacccatttattgatccttttcccgttcatgggcagctttttttgttctttttgtttgtttgtttattaagacagattctcactctattacccaggctggagtgcagtggtgcaatctcggctcactgcaaactccgcctcccaggttcaagtgattctcccacctcagtctctcaagtagctgggattacagccacccaccaccatgcctggctaagttttgtattgtattattagtagagacagggttttgccatgttggccaggctggtcttgagctcctgacctcaagtgatctgcccgccttggcctcccaaagtcttgggattatagatgtgagccaccactcctggccattggcagcttttgatttcctgtcctcccaacttccaaagtttatgaagagaaatctgttgataatcttattaaagatttcttacgtgtgatcagttgcttttctcttaccgatttaaagattctctgtttttgacttttgaaagtttgattataatgtgttttggtgtcggtctctttaagtttatcttacttggagtttgcctggctactgtgtttgtattcaggtctttcatcaaatttgggaagttttcagccattatttcttcaaatattctctcttgcccctctctccttcttctttataaattccacaatgcaaggctgggtatagtggctcatgcctggaatctcagcattttgggaggtcgaggtgggaggatcacctgaggtcaggagtttgagaccagcctgaccaacatggagaaaccccgtctctgctaaaaatacaaaattacccaggcatggtggtgcatgcctgcaatcccagctactctggaggctgaggtgggagaatcgcttgaacccaagaagcagagtttgcggtgagccgagatcacgccattgcattccagtctgggcagcaagagcgaaactccatccccccaccccccacccccaaaacaacaacaacaaaaaaggaattccacaatgaatatgttggtccacttgatggtcacttaggctctgttcacttttcttcaatttttttttatttctgttcctcaaactggatgatttccattgtcttatcttcaggttcactgattgtttcttctgcctgctcagctttcttcaaatttgactttgaatccctctagttaattttttatttcacctattttacttttcagatccagcacttttttgtttcttttttgattttctatcctttatttatattttcattttgttcatgcattattttcttgtcttgtgctacatcttcctttagtttttgggtacctttaagacacctgtttcaaagtctgtcaagtagcacatccagcaggttgtttttttctctctctctttaattatttattatttttcttttcattttcttcccccatgaccaaatcttaacttgactatcaggcatttttcagtgagagtttctgttggttcatttttttttatttatttttattgttgttgttgaaaactggacatttgaatctactagtgtggttaattccagaaattagattctcctccttcctcagggtttgctgtttttctgttattgttttgttttttgattattgtaggttgtctctatgccaaggatcagcctgaggtataaacttatggtcttcacagatgttttctgagcctgaacctttccctgggtgtgtggtcactccctaattttacctatatatgcagttattcttgaatattttatcctttaatgtctggctcccaaaaggggaaaaagagaaaaattgagggagggtgaaaaaagggcaccatccctttaaactttctggaagttgcttcagcttagggtgaggagcttgctacaatgggggaaggtacagcagtagctgccagcctctttgtctctgtgctgcaatcagacattagagaacagagccccaatgtgtgtgtgtgtgtgtgtgtgtgtgtgtgtgtgtgtgtgtgtgtgtgtgttttgagatggagtctttctctgtcacccaggctagagtgcagtggcatgatctcagctcactgcagcctccgcctcctgggtcaagtgattcttgtgccccagcctcctgagtggctgggattataggtgcctgccaccacacctgactaattttagtagagacagagttttaccatgtgggcctggctggtcttgaactcctgacctcaagtaatccacccacctcggtctcccaaagtgctaggattacaggcatgagctactgcacctggcccagacccccagtgtttggagacagcattctttttgcccattctggatcctgaaagatgtgtgcagcttactgtaggaacacaagctgactgccttgggggtagtgttgggtagctgctattgtgctaagggccgaaattgactgaaattacctacaatttaccatctgggccttcctctggaagttgcaagccttcagtaggctccagagttctgaaatatttacatctgacagatcctgcccatgcagttgttgtgtagattccaggtgcttctcattccaccatcttcccaggataccctctgaccttctggattttgaattcagtcaagctgttctctaacagctggggtgaaagccaacaaagatcctgctaagaaagctccctggaaaaaaaatgttcaaaagtaacacaaatatcaaactggaaagaaattgatttaggaaccgaacccaggttgtcatggtgaaaaaaggagcagaaccttagctaccgaactgcagcctggggtatgaggtgacaaccatcacttttttagtttggtttggctagcaaaggtggccttgttatacaaataaagccactcaggtagtcaaaacctttattttctgttttttttctctctctttttttttctttttgagaaggagtcttgctctgtcacccaggctggaatgcactggcgcaatcacggctcactgcaagctctgcctcccaggttcatgccattctcctgcctcagcctcccaagtagctgggactacaggcacccgccaccacgcctggctaattttttgtattttcagtagagacgacgtttcaccgtgttagccaggatggtctcgatctcctgacctcatgatccacctgcctcggcctcccaaagtgttgggattacaggcatgagccaccgtgcctggccctatgcctggctaatttttaaaaattttttgtagaagcagggtttcgccgtgctccccaggttggtctcaaactcctgagctcaagtgctccaaccaccttggtctcccaaagtggtgggattacaggtgtcaaccactgcacctagcctctaaatccatataaatcaattattcacgcactgagcagaatattcaggattttttttcttataatataaatgatgtggaaaactggagaaccaaagaagaacaccaagactatctaaaagtgttaaatttttcattagaaagaaaatgacttcatgacagttcttaagacaatgatagaacttggggaaatatgtattccttgatgtttctatgcatttgcaataataaacaatgaaaatatggttaaattttagaaagagataggcctgtggtattgtcacaagggtatacaaatactgagaatgactgctgaggcagtgctctccattggtggtgaccttcagaagagacctgtgtttccacatggcctagacacctggaaggcagagatcctaacattccatgacacccccaccttctaattctgttattgtgactccagaccattacctggcaccgggtctgatttctggcattcctatcagagcctgagtcacagacagtaccttagactctaagcttaggcaccttgtgccttgtttttgtggctaaggattctcagagttgtaggatgctgacaaagtttatcccaaaggtaatttatgaatcagatctgctttcttttgacttgtttaaacccttcatttaatgtaaagaaactttattgaggtataatttacatactataaaatttacccattataattgtacagttcaataatttttagtaatttacccaagtagtgcaaccattaccacaatccatgcatttgtttttaatttattaattgtctgggtttattctccctaggctctgattgtactttctccacaagcttcagcatggcagtatctctcaccacttgttttggtccaagggcagaaatgagcatcctggaaaccaatcagtacttgctctctgaactggaaaagtgcaaagagaacttccgagacctcacagagaaattcctgacatccaaagctactgcctactccctggccaatcacctgcagaaatatagtaggtcccataggggcatggtcaccaaagtgataaatgattgtctgtctttcctctgtgaaatgaaacactgcagactttattctttatcaaaattaattttatcctaactacactcccagaaaggtagaagtgggccttttactctcaatttgccaaggacagaaaaactgaggcacaaaggtgtaaagtttgcagggcgagtgtagtgaggaatagagactaaaaccttggtttaggcatgaaactgtctttcccctctcagcaatgaatatcagattctacaaacatgtaacatcactgttggttaaaacatctcaggatttgatttaaacttttttaagagcgcccatttgcaaagcactgtgccaacagcaccagggatgaaagaagtaatagtataccctatctgccttgaaggaacttaaaactacctattctcaactgagtcacagatatgtggagatgcaaacttcaatagcagacacggagaaaaatctttatgatacctggatcaagattctcttcccacataagttcacataagccattcctcatgttctggttagattgagggtatttccataaaaatcagtgactttgttacaccctttctgtctctctctgagtatcaactttacagacagcaagcaactgcaggtggatgtccaggataagagctatgagacatatggccaaaatgagaacaaggccaagtggaagagaccgccattctcagtagacggccaggccaggttaggggctggccctttcctctccacagttagctctcacatttttaaatccaatgtaaaatcccaaacctgttactaatagtcggagaagggggaagctataatgacaaggaaacatgggaacaagggcatgagaggaacagggatattagaagaggattctggttaacattgaaattgagtttgctttccaatttctacaattgtttttaaataaatcatcgtgtggggggtggttaaatttgctgtctaacttactgtcatagaaaagtaaagccaaaagcccacttattaaagaagtgaaaagatgagctttggtttgttgaaaaactagttaaaaaaaaaaaaaacttcattcattataattgtaggaaaaatatttctcaagctagagaagaagaaagatattacctaagaccttagtataaaggtattattgtgcagtgattaaagagcatataccctagggccaaatctcctgggttcaaatctaacttattgtctctgtgcctcagttttctcatctgtaatggtaacagagtaggaactacctctttggatagtggtaatgatcatatgatcataattcttaaaaacctactgcaacagtaccatgacaaacactatgtgttggttctccctttaaaacactattagcatttgggcatatatcatttggatctttctcctccatatacagttttacacagttgtatacagataaatgtttaaatctttgaaatattttcgaattattgaaactcttgaaacaggagaaccatcagttctacagttcttagtatcttcctaaatacacaggaagtcattatttcatgcccttatgttcatgttttacttaagaggctgtaaagcttggtgaattggccttaagatttgaagtcatggccgggtgcagtggctcacttactgtaatcccagcactttgggaagccaaggtgggcggatcatttgagatcaggagttcgagagcagcctggccaacatggtgaagccctgtctctactgaaaatacaaaaactagcagggtgtggtggggcacacttgtaatctcagctacttggaaggctgaggcaggagaataacccgggagtcagaggttgcagtgagctgagatcgtgccactgcattccagcctggggaacaaagtgagattccatctcaaaaaaaagaaaagaaaagaaaagaaaaagatgtggagtcagaccccatgggacgtgaattctgactgcttcattccagttgaatcatcttgtcaagttactttatcggcctgtgggcttttctttcctcatctctaaaacagggagtagttgagagactgaggaataaagatatggaaatcccagtgtaaagcctggtaccggggatacttttatccttgagatagaccctgcctcctgccctgcaggcagtgaccacagcagcatggccagccttccatgatgcaggcatgtctgtcttctctcagagtgtgaagagtgcaaagaccttatagaatctgtgctggaggaggagctgcagtttcaggagagggagctgaccaaattgccaaggccagcagcaaggctccggtaaggaggtacctctgtgggaagtgtataaatactgtttgaggtggggcagctcaggcaggtagaacaaagagcaaatttgtgcaaggagaagggcagaaatgtatgaggcaggtacagaactagactaagacacaatgaggctatagtctagttaggtctctagggttttccattaaagaacatattagtaaaatggagacagctgcctgcattggaatactagcaacgtggcttctatttgtgtatccttggtcaaatttactgcacttttctgcatgtcattaacctaggctacctcatttataaaacggaaatactgacagtatctaccttagagggttatgaagattaaatgcacaattgcaagtagttaaaaccatctctaacacatataaaactctgaacaactattttctgtaattattttatttgttcccatttatagatgtggtgattgtcattaacatttcctataagagatattttcaaactttccaaagtgcctttcatgataagaaagtttctcctccaaacttttttaaaaagtattatactaggtgaagtattaactggtagggctattgggtagatagatgattgagcagctgttgtgtggaaaatgaattattaattcactcaggaccagcattgactatccttagagggtttcagacataaggtagattgtagcatttgaaacttcttttaatcctttgttgaaatgaaatcatagaagctcaaatgtgtaaaactcaccaaagcagagatatttgattgaaggagggataggtctggagcccctgtttctcgccagtatgtgtctttacttcccctgacactgtctagtaactctgtcgaatagagtttgaaagaggacctgcagataacaactttgaagaatagcagggagaaaattcaagcattagatggggtagatgactgtaaatgttcagtccagctctgggattacatggttctaaacattaactgaataactacttgtatgtgtacatactaccaggtgctgtgagttgggtaataggtggcactgtctttagactcacagagctcacactctacattggaacccatgtgtattagtccattctgacactgctataaacatgtacctgagtctgggtgatttataaagaaaagaggtttaatcggctcatggttctgtgggctgtacaggcttctgcttctgggcaggcctcaggaaacacaatcattgcagaagttgaaggggaagcaggcatggtcttcacatggccagaacaggagagagagagagaacaaagagggaggtgctacactttcaaacaaccagacctcatgagacctcactcactaccacgagaacaggaagggggaagtccacccccgtgatccagtcactttccagcaggtccctcccccaacattggagattacaatccaacatgaggtttaggtggggacacagagccaaaccatatcaccatgagaaatatttgaacaataattagaaagcaatgaaatcccacatagagtaatgaagttactactcagaacattacttcttttttttgagatggagtcttaccctgttgccgaggctagagtgcagtggtgtgatctcagctcactgcaacctccacctcctaggttcaagcgatcctcctaggtcagcctcccaaggagctgaaagtacaggtgcacaccaccacaccagctaattttagtatttttagcagagatggggtttcgccatgttggccaggctgctctcaaaactcctgacctaaggtgatccgcctgccttggcctcccaaagtgctgggattacaggcatgagccactgcacatggccggaactttagttttaactgccttcttactgattatggtctaccttcatgtcattcaaaagaatactgcccttcttgaccttttcactgatttttctttttaactttcaattaataccagagatacctgcccaacacttttgaatctggctttttttttttctgccagttactgcataatgcttgatgtatattgtatgaaaatgtacttgggctaaagtggggaaccaaaggggcatctttttaaagcaaaggtagtaaaataacagacaaacccaaggctggttcttcattccttctgccacaggcaagtcacacaacttgtacaagaattaatcttgggccagatgcagtggctcatgcctgtagtcccagcactttgggacaccgaggtgcacgagtcatttgaggtcaggggttcgagactagcatggccaacatggcaaaaccccatctctacaaaaaatatataaattatcctggcatggtggtgggcacctgtaatcccagctacttggaaggctgaggcaagagaattgcttgaacctgggaggcggaggcagaggcggaggctgcagtgagccgagatcttgtcactgcactccagcctgggcgacagagtaagattctgtctcaaaaaaaaaaaaaagaaaaaaaagaattcaacttgggagttccttacagggattctaagagatctctcctctgaaacttctataacctattattcactacattccctcttacattttactcttctttcccaccttaggatacatgatcccttaattcaggctcaggctgaagaactgacccacttacgacagaagatacaagaagggagaggtgtctgctaccttttcacccagcatgtgaagaacacagtcaagtcttttgagggccttctcaggaacactggcattgcctactaccagagacagagattctgtgagcaaatggtacaaggaagccagctaacagagatccttgtcagaaaacttgccacaggtaagttggctacaggctctgaagacccttacctcctcccaagtgccccaaagtggggagaaaaaatgcaaagttatctccattgtagattttattttagttttgactatggtccttaatctgcattctattgttttctctttagagcactcaggtaatcacttttcatattctttcaagagtcctgagttttgttttttattttgagacagagtctgctctctaacccgagctagagtgcagtgacgcgatcttggctgactgcagtctgtgcctcctgggctcaagcagtcatcccacctcagcctcccaagtagctgggactacaggtgtgtgccaccacacctggctaattttcatattttttgtagagacagggtttctccatgttgcccaggctggtcttgaactactgagctcaagtgacccatctgctgtggcctcccaaagttctgggattacagatatgagccactgtgcctggcctgagagttcttagtttcaatcagtaagagaggtagagtatagtggattacttcatcttgatgagcataagaactcaccttcatttctggaagatattttcactggatgtaggattctagttgacagtttgtgtttttaaaaagtgtttgaaaagtgatattccactgtcttctggcttacattgtttccaacaagaagtcttccataattcttatttttgtttctctgtacataatatgtctttttctctggccgcttttgagattttctgtttatcactggtttgaagcagtttgattaaggtaagaccatgtatagttttatcttttaagtattgttttactttatttagtttcttgcatctgcatgtttatagttctcatcaaatttgaatagtaatgacatatatagtcttatctatggcatatacagtatatttggcatatatatatcaaatatatataatgtatattctattctttctctctatcctctccttcaaagactccagttatatttgtattagctgctttgaaattttaccatagctgactaatggtctgttcatttttgttgtatcttttttttctctctttgtttctttctatttccatgtctcggaattgattaatctttctttagcagcatctaatctgctgttaatcctatccagtgtattttcatctcaaactttatttttctttttttttttattttccactttgtcattgtgtgttggttttttttttttttttttttattatactttaagttttagggtacatgtccacaatgtgcaggttagttacatatgtatatatgtgccatgctggtgtgctgcacccactaacacgtcatctagcattaggtatatctcccaatgttatccctcccccctccccccactccacaacagtccctagagtgtgatgttccccttcctgtgtccatgtgttctcattgttcaattcccacctatgagtgagaatatgcagtgtttggttttttgttcctgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacatacgtgtgcatgtgtctttatggcagcatgatttatagtcctttgggtatatacccagtaatgggatggctgggtcaaatggtatttctagttctagatccctgaggaatcgccacactgacttccacaatggttgaaatagttcacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcctttgctgtgcagaagctcttcagtttaattagatcccatttgtcaactttggcttttgctgccattgcttttggtgatttagacatgaagtccttgcccatgcctatgtcctgaatggtaatgcctaggttttcttctagggtttttatggttttaggtctaacgtttaagtctttaatccatcttgaattgatttttgtacaaggtgtaaggaagggatccagtttcagctttctacatatggctagccagttttcccagcaccatttgttaaatagggaatccttttcccattgcttgtttttctcagatttgtcaaagatcagatagttgtagatatgcggcattatttctgagggctctgttctgctccattgatctatatctctgttttggtaccagtaccaggctgttttggttactgtagccttgtagtatagtttgaagtcaggtagtgtgatgcctccatctttgttcttttggctgaggattgacttggtgatgcgggctcttttttggttccatatgaactttaaagtagttttttccaattctgtgaagaaagtcattggtagcttgatggggatggcattgaatctgtaaattaccttgagcagtatggccattttcacgatattgattcttcctacccatgagcatggaatgttcttctatttgtttgtatcctcttttatttccttgagcagtggtttgtagttctccttgaagaggtccttcacttcccttgtaagttggattcaaactttatttttcatctaaatttaatgtatgtctttctttaaggtcttctatgtaactcttcatcatttcgtattttgatctagcttctttattttattttattctattttttgagacagagtctcactctgttgcccaggctgaagtgcagtggtgagattttggctcactgaaaccttcacctcctgggttcaagtgattcctatgcctcctgtgcctcagcctcctgagtagctggggttacaggcacatgcctccacacccagctaattttcatatttttcagagagacggggtttcaccacattggccaggctgatctcaaactcctgacctcaggtgacccacccgccttggcctcgcaaagtgctgggattacaagcatgagccaccacaccagcctagcttctttaatacaaggaatatagttatgtttgtttcaatgtgcttgtctacagattctgtcatctgtgtcctttttattgttttttaattctcacctgatgtgtcctttctaagtcagtttaagtagattgattttttcccccttcttatcatggattatagttttctgtctgtctgcattcctaacattatttgatttggggttagacgttgcaaattgtaacttactgagttctggatttttttgaatttagtgttaaaattattttagctttgttttggtatacaataaagttacttaaaaacaattttcatcttttcaggatggcttttaaatttttttaggcaggataagagcagctattagtcaactgctatctttttcccactgtggaggcaaaatgacttttaagaaaatagaccttattttttagagtagtttcagattcacagcaaatgagcaggaagtacaaaaagttcccatataccccctgcctccacacatgcatagcctcctagattatcaacatctctctccagaatggcacatttgttacagttgatgaacttacaatgacatgtcattatcacacaaagtccatagtttacattgggagcaataatcttttgaagattctaagtcagtgatctcccacagatttggcaccagggactggttgcatgaaagacaatttttccacagacaaggtgggggtggggtggtagggattgggaattgggtggtttcagtacgaaactgttccacctcagatcatcaggcactagttaagagtctcataaggagcgtgcaacctagatccctggcatgtacagttcacaatagggtttgtgttccaatgctaatctaatgtcatcgctgatctgacagaaggctgagctcaggtggtaatgctttctcgctggctgctccccttctcctgtgcagccccattcctaacaggccatggaccagtgctgggggttggggactcctgttctaaccaatgctccctctattaaaagggattttcactctagctgatggaaacaccaagtgttgcaagctatgtgtgagctacagagattattccttttgggaagttctttgccctgctttgcataatttcctcaaatacatgtactaatcagtacttagctgaagattgaagacagatatccaaggcattctatctgtgcagcaacctattctctagtctgtcctgtgatgtctagccaccctgacttcttcaaacttactaccaggctctgcctgggtcctccctccctgctctacagttgacaatctcaggcagcaaactggagcaattatagggctcacctcttttatttattatagtactgcactatatccaatgttgaaggtagagtttaaaatactttttccagtttctcagttgtttaaggtggaggacaaatcaggtctccattactccaaattggccagaagcagaagtctccattccatctttgtggtcagaaagaacagtatgacagaaggcagcttgttagaatgggaagacccatgggctaagaatcagcattacctaggctctagtctcagcactgtatttactaactttgtgcaagtgattgatccttcttgaatttctgtttccccatttgtaaagtgggtcaaatcataattccatggctgctgtacagatcagttgaagtagtatcttaatgttcatgagtgtatttctctttcagggttatttatttttttatttttgggtcccaataaaccgtccaaatcttttggggttagttcaggcactgtatatagtagaagctggtgttagaaaagttgatttatactggaatatttttcacagaatcaaccccaatgctcactaacaaactgagaagaaaaaaaaagaattacccccaacaacatctgaggaagcagaacagggacagacttgaaggcacctgggcagtcctctggttttggagtagaggtaggacagggctatttgtcctctcagagactggagcaggttctgtgtgtgagtagcaatgggacaaacagtcgtggtctggcaaccagcctgtagcaggaaggaaggttacaactggagaagtccaaagggcaaccaggcaagtattctttgagctggggaacaaaaggcattttaaactttttgctctgcttcaggcagctgacgtctggtgatgattcaccatatcaggaacaccctgtccagtgggctcaggcaagcctgccaggccacttctctaaagacacaacctgaggcctcctgcaataattctcacagagcattctgaacatacatgtaaggtgttatgtccctgatcatatagggcccatgtgtgcaatgtgtgaaatgggacctgcttaaattctgactagctctttctaattttggcttgcagaaaatcacaatggtaagaaaatgaagacaggcaaaagccactggctcccaggtaactctacatgatgaaggggctgataatggactgaccaaatctagagagaattccagaagcaaggactcaagaggttaaaggtcccagatctagaaaaagcagaaactgctgattgttcctttttttgttgactgattatacaatgtgtccttttaaaaatggttctctgttctctttgcagttgttgtattggttcctagttcctagtaatttctcacacttagttaaccagtcagtcttaccgaaaagtaaactaaccagggatccctggtttctgtatctttaaaacctatagggttacaaaccaaagtgagatgcctatctggtttctgcacagttgtcctgaattatgttggcagatattttatagccagaaatttaccttgaaaaataaattgaaaccataccaagtatttagagctaggggtctaaaatctgcaaaagccctgggaggttgtgttgtctcaagagccagtattcagtggaccactccacatcatattaaataaaatttaaacagcattttgaagccgacagtatgggtcactgtgtgtcctgtgtgccgtgagcgtattgtagagtagttgttgagtctgctgccttatctgtgtgttatgaggtcaatgcactgatcacttgcttttttcacttctatactaactctaggcacactttactcccagtcaaaagtggactgtatacttcctctttgatgtgatggtccctttggttttggtgcctcttccatgagcttcagatcagaactagctatgtggttccaggctgccctggtttaatcccttgtcttgcctacttcacctggctcaagagggaagtccaggaggaagaaatggatgaagtcctggaggactcactagatgaacagtatttgactcattccagctgccatgactcccaccagcttcccagcagcaatgccttcctctttgatgcacaggaaggcccctcggctgtggaaatagccagtaagtgctcctttgataagaaaaataaagctccatcaatctctcagtagctcctacattctacatgctcaccacctctgtctaaactgagagatgttattctctgcaggcaggccctaaacattcactttaaaaaagtgattaggctgaacacagctctgggatcaactctcaagtacaggtccctggtgggtcaggtaatttgctctgttcctgtcctcacctcagtccctctggtccagacgggcatctgcaagccggtatactcaaagcaggccagaatggagagagtgaagagattatggcagactctctgccactactgccacacatgtacaaatctgtttaacagatcttcttctttaaaatgggacatctcatctttcctgaaatatatatattttttgagacagggtctcttgttctgtcacccaggctagagtgcagtggcatgatcttggctcaccacaacctaaaacccagggtcaaatgaccctcccacctcagcctcctgagtagctgagaacacagatgcatgccactactcctggctatttttttttgcctttttggtagaggtgggttcttgcttttttgcccaggctggcctcaaactcctgaactcaagcaattcacccacccctgcctcccaaagtgctgggattacagatgtgagccactgcacccagccttcctgaaatattcttggtaattatagttcctgaacagttttcccaagctgttctagccatcccaagaatgttggcaggcttgtccatatgtttggaggtgcaattataatggttcctgggtttcaagctccagtctccatctcccctcaggtgcttgctttcccataaggttccatctgactactggaatatcaggggatttccataaagacaagactttgatcttggcaaccctttggtaaatagccagggttctcaatctttgtgcagcaccaaggtatttttaagatgtctgttagtttagtctcagtgttgtaattccatctaaataaacaatgaggctatctgctggagaaaaggctgaatctaagagcaatgctgccagcatgccctcttcccagaataactccacgctagccattggagcttcattaggtatataagagccctttggtttggtagcctctctggtgtgtgtatagattaaatccttgacctatatctcctctcccttacttgaatgtttgactttactttgggggcaaaagtttggattgttaggagactatatgctttatatactcttctatgcaataaaaagagattatattaattcactcattgagctttcacagtaatgtaaaccatattaggcttgtcattctgtcagtgatgggtgtaagtttgtggctttaattagtcataccatcttctgacaaaggcatccttatttctctttccaatttcacagtaaggtgtagaagaaggtctttaccatctgttaaagatgttcagggccgggcacggtggcgcacacctataatcccagccctttgggaggcctaggtgggtggatcacttgaggtcaggagttcaagaccagcccggccaacatgctgaaaccccgtctctactaaaaatgcaaaaattagctaagcatagtggtgcacgcctgtagtctcagccacttgggaggctgaggcatgagaatcctttgaacctgggagacggaggttgcactgagccaagatggtgcctctgcactccagcttgggtgacagaatgagactctgtcaaaaaacaacaacaaaaacaaaatatgatcaggagagatattttgtagagaggaagatattccctagtacctataagtcatctcaaggaggtggtcataccttttctagtgctagaaaaggcctactcagagaccttcagtgttttcccacctcctgtcaacctgccttatacttcccatatctccatgtgggaggcatccctgtggagtttgcttagcacttggccatgctttctttgaaaccttaaaagctcgtaaagaaagttgccttatgttccctgatgagaagatgaagttggcaaaagaatggtgaaaggcagggatcttgatgagaggcccctgactatccctttagtgatcagcatcttcacttcccatctcattccatgtcctggtggaatggctgcagaagatgagatccagagccagtggcagcacctgaaagagatccttttcatcaacaactgcctgtgagaaaagctagaacatcatcacagcagctttgacgaagaaaatggtaggagaggcccaagtcagcctgcttctggcaatatgtatttttctaaaggcatgtgactggggcagagttttatagatttcaagcactttgacatactttacttcacttattcattacaaatgtcccagctagagaggtagggcagctactatcattcctatttataggtaaataaataggcttaaagatttgccttcatcttagtggtatctacctctaaaatcattcttgtgattcctaggctgtcttctgtcttctgtctgctgctgtacactgcctgctgtctctctgcttcttatgtgattggcattcagtagaacccaggtttctcagcacctcacgtagcagaatgagagtctcctctgctgccatcctcatcagtttcccttatgtcttggtgactcttcattctaccaccccaaggtggttctctccaacccccctcctcttagattgttctcacacagaggccgtcatttcataacattgtgctgggccagaagaatcataagcaggtcccttcccataccaaagcagtaactattttggaaaagcctccttcatattgcagccattggacatgataatacatgtgatgtgctggcatttgttgagaatcatgtgaaaattaagcttccaccccatcacactaacgttccagccctccacggttttctccctaggctaagatagagaggaagaacatgaaatgtgcagaaagcattctcttaagcaaacgtgtataacttgcgtaaattgtaattatttcctggaacaggatgcacctctaacctctacaggcaaatcatagattccattgtccagctgtaaaatgaaaacagagttctcagagaagaataccggagactcccccgacttgcctgaatcaaatttccagaggtaagtggtgaaaggctacaatatgaagtcactctcagatgggtcccttctcttgccacactccactgtagaaataaaagaggacggggaggccagagctgctcaaaaccttataacccacaattctcatagtcattctcaacttagagagggctgctttctagacacaccccctccaggcccccagactgccaggctccaggaataagtagctctaagaaatacagtatttcgatgcgagccacaccccactattgcaaattggagaagagaaggacaaacttaaaaggtgaaaagatttaacagaacaacagggtgaaaccccatctctaataaaaatacaaaacttagctgggcgtggtggcatgcacctgtagtcccagctactcaggaggctgaggcaggagaatcatttcaacccaggaggcagacgttgcagcgagccaagtttgcaccactgcattctagcctgagtgacagagcatgactccatctcaaaaaaaaaagaaaaaaagaaagacagaaaagatttaagagaacaattattttaattgaatacattttgtcaagattaaatcaactttcccctagaatactgaaagaataagcaatcataatttagattctaagttactggcctttgagaaagtgtgaaatccaaaaagatgccatgagccaaaaaagagcaaaagtcctaattttcaaactgatgaaaataaagtactaaataattgaaatcatcgtagttcatcttggtccttggcaaaataaaaatttattgattgaaattataatatcctagctacctttttgtgcctagctcttaccactgaggagaaaaaccaaacacaaacaaaagtatgttcaaattggcaaaaatgtttacaaacctgcaaaatctcttcagcctatcccttaaactgcagacttggtatttactaagctctgctgtgtacaatacccaccttaatatccattcttgcacaagttctgttaggtataagccaaaatcacatgggatttttttttttaccctctcatgcctatgtttgcttttgcttccaaagacccttctgagtaaggactgtcctcagactactggagtcacttagtcacaagcttgcctgaggctcagagctggcaatacctggcagtttatgtcaatcccacatgcaaccctgcctgcaaagtatttacccatgattgacaggtgcaggtgtatgaaagcccagctccttgacttgaggggtgcgtttgtggtgaattagctttgggaaaagggaatccagaggccaactttgtaaaaatccagataggtaaatggagagaaatctttgccttggaagtccaattgagaaagatagtgatttacttcggactgtgaaaggagagactaaaatctttactttctcatgggaaagaagcctatggtgaaagagaaacaaagaaaatggtgggaaatagggtaggtctactcagtagctttaaaccattctgtcatattataaagcctggtaaggttttaactaacacaagtgcctggactctacacatagatattctgatttaaatgcttccaggtgggtggaagacaccagtagtcttaaaaagctcccaagtaattttaacatgtagctaaagatgaaaaggacaatctatctactagaatgtcaagtcgtcagcataggagtgtcccaaatgtgcagctacctcatagaaaaggcttaaccccacccattgatggaattcgccttcctctctccatggtcttgtttgcatagcatggaaaaaaagagaagagaaaaagaggtagatggatagattgaacctataatttgccaatgtggagcagtttctcaaacttttctgaccacaagatgcagtgagaaatacacaattttttgtgatcagtttttaaaaaatcttttattatgtgtaatccacccttcctggtatttaaataaagcctgtagtagtaagcagtccactatattgatttcacaacccataagttgttcagaattgcaattagaaaatttttaattttggccaggcgtggtggctcgcacctgtaatcccagcaccttgggaggatcacctgaggtcgggagtttgagaccagccggaccaacatggaggaaccctgtctctactaaaaataaaaaaaaaaatttttttaaattagctgggcgtggtggtacctgcctgtaatcacagctacttgggaggctgaggcaggagaactgcttgaaccctgggggtggacattgtggtgagccaagattgtaccattgcactccagcctgggcaacaagagcaaaactgtctcaaaaaaaaaaaaaagaaagaaagaaagaaaaagacaaagaaagaaagtaagaaagaaagaaaattttttttcacttttgctcggcctttttatcaaggaaaatcccaaaagaacatttactgtaaaagaacattgactataaacatctttctgtgaatccttatttctgtcccagccaccatgacccaataatctctaaaacctgttagtgttctccagattgaagccttccctctaactgctcctaaatctgtgatgtagtggaaaaggtttgaggccttgattctcagcccaggtttttcacctacagatcatatggccttagcctcttgacaccattgtctccttatggccaaagatggaactgtacttgggtggtatctgagcaccctgttggctttgacattctagggctcttcccttggcaccactctcttatttaaaaggaataggatgtggacttagaagggttatttctctgcaaactatcctctctttcttatgacaagctatttctgaatgtgcacatttgaggctaagcaaatcacttcctgggaggtgtgaaagacctttatttctctccagaggagtattatggaggtggtagagacctagctaactcatctgcagcggctttgagcaaggcttttagaaccataaggtggctggggtcctgtgtcctacaccacaggccagctagttcatttcaggagactttcttttcaatctattattactatcttcttctagactgtagttcactaccagagattatccacttagctgcactcagtttacacctggcctgtatcaccacttagctctcactctagcctcagttaggtatcagcaagacctcaccaaagattattgtttcgttgtatgtgtgtgtgtgtttttgtttgtttcaagtagcaactaatgttggaactatggaaagttcttctctacttttaacaaagcttagtcacaaacagttccccagttgatgagaaaaactaaaacaacagaacaattgaaagtccaaatctgaaagctccatctctgagaagcaaattttatagccactccagatttgtattccaaatggatagtttgattatagaaatcacatcccttcagtctgcaaatgtgataactgaccaagagacagtgatgcctagatccataaataatcccctttcccccaacctatatataactggagtcaacagcagctagaggaaaatggcaaggacttggaatcaagattaagttagaataacactgctgtagactgttcatcagctcttcagcatatgtccattttccttgagggataagcctttagaaacctctgacaataaagtttattttacacacattctcttgcctatgatttttttgtacaaatcacaattacaaaactttcttgctccagctaaaagcaggaaactcagtcacaaatgtgttcactacatgtataccacagaatgatagcagccagtctgaatgcatcacttgattccaaaattaaatgttagcactcagtagtgaaactacatgtatctccaactctggaagccccaggcaagatactcctgtttcctgcagggaaacagatctataagcagggcagcagtctcacacatgtacattcctgggaaacccaaggaaacaatgatagtgatgcagggcaggcgagcctcaaaactggtttgtagcccgggaaatttcttccagactgtagtttccttggctttgccaaggaaagaattcaagggcaagccgctggtgaaagaaagcaacttttattgaactggtgctgctacttgcagagcagggctaacccataggcaatgtgcccagagttggtgcctgtgggctgctagctagttgtttttagacccacttttaattacatgccaattaagaggtaggttattcagaactttctggaaaaggggcagggagtttccagaaccgtataaagtaacttccaggccattgccaaggtgtgttgccatgacatttgtaaactggccatggtcccggtggtagtgtctttatgctcataagtagtaagagcaactagaggtcactttcatcatcatctgctggtttcagcaggcttcttcactgcaccttgttttgaccagatcctgctctgttcaatggggttgtgactggaaaataagtccttctggtctcctacctcatttccccatcagagattatatactcctccttaatcttaaggggcttgtagaagggtggaggttcatcttctgtaactgcttcctgctgatgttatgggcatagaacctgcctagcactggagaagtaaaatctctggatacctgttctaaaagacccaaaggcaggatgtctttattttctgggtcagaagaggggatgggttgaaagccttgtgccagcatcgtctttacatggaattattgtaatctagaagacacaaactttacaaggaggttaaacaagcaaggaccaaagattagtaataacaagatatctgttaaaggtcctaggaagggtaaaaatcaagtgtctgctggtagagattcctttattgaattccatcagcagggcaaagcggtaagagagaaaacattataattaggagtaagagaaaaactttcatgctcatccacagcatcatgttattaatatttatctgtgcatttgcaaaacaatagctttaagtcttctgggagtttgcaagtataggtcatggcatcttcctctgacatctgtgaggactcataagaatctttgaggctgggcacagtggctcatgcctgtaatcccagcactttgggaggctgaggcaggcatttcacaaggtcaggagttcaagaccagcttggccaacatggtgaaacctcatctttactaaaaatacacacacacacacaaaaaattagccaagcctggtggcacgtgcctgtaatcccagctactcaggaggctgagacaggaggattgcttgaacccagaaggtggaggttgcagtgagccgagatcgagccattgtactccagcctgggcgacagagcaagacttcatcaaaaaaaaaaaaaaaattaactttggagtttaacagcagtgggagtgcttaataatgcctgataggggccctttctattttggttgtaattgattcttgggggatccttctttctaagtttttagtaagactaagtctcctggttgaatgggggagttaatccttttccttgtgggaagttacgtttcatttccatatgattgaagggccttttgaacctggcctaagttgataatctatgtgtctcttcatcaaacagaaggtctaaagttaaaaagggccttccgagctgctcaggcgacccagtgctcggttggcccgggccgcgcttaactgtcccaggtcagttaagcccgtgggagcccaggtcatggggcagccagggcctctgcagtgtgaggcgccgggctgcgggcgggcaggcgggaggcttagggtgggtcgcggtcgcggcccccgccgcaggccctggcggcggcatcgtgaacatagacgtggagttccacatccggcacaactacccctggaacaagttgccggccaacgtgaggcagtcattaagtggagatagctcatcatggaggtcttcatctttgtcttcacatcaagtaggctgaggaggaggaaatacaggaagtattggtcttgctgttcagagtggcagaggagaaagaaaatcccagccgtcttggaaattcacagagagaatatgaaaatcaggttgtcctgtacagtatctgcaatcagttacgatacagaaataacttaaacatgtcaagaaagatgaacgcagatactatgaggaactgctaaactacagccgagatcatctcatgctgtacccttaccgtctattggatattatggtgaagagcttgagcataacaccattttcatattacactgggattatggagaatattatgaacagtgggcacaattttactgctgctgactgtctaaggcttcttggcataggaagaaaccagtatattgatcttatgattcagtgtagatcatcaaaaaaattcttcagaaggaaaacagccggtgatcttctaccaataaagccagtggaaattgccatagaggcatggtgggtggtgcaggctggatatatcacagaagatgacatcaagatatgcacttggcctgagaaatgtgctactgataagaccgttgattcaggccctcaactctctggatcactagattacaatgtagtacatagtttgtataaaaaaggatttatttatctggatgtaccaatgtctgatgacagttgtatagcagttgcaccccttgaaggttttgtaatgaatcgagtgcttattttgattattttgaaactctactctataagatatttgtttcagtagatgagcacacaaatgtggcagagcttgcaaatgtccttgagattgacttatccctggttaagaatgctgtttcaatgtattgctgattgggctttgcccataagaagggacaagtaataaatttggatcaacttcattcatcatggaagaatgttccatccataaacagattaaagagtaccttagatccatagaagatgctcttgtcatggggtggaggggaaagtaggaggcctgtacaagaagcttcatcggcaactgacactgatacaaatagtcaagaagatccagctgacacagccagtgtaagaagcctgagtctgtctgcaggacacacgaagcacatcgcattcctgtttgactccactcttactgccttcttaaagatgggaaatctttcaccagttcagagcactggtgaaagagaagcacagagatattttgatcatgcgcttactctgagaaacacaatactgtttctgcgtcataacaaagatctagttgtgcaaactgcacagccagaccaacccaattatggttttcctctggatctcttacgctgtgaaagccttcttggtctggaccctgcaactggcagcagagttctaaacaaaaattacacactgcttgtttccatggctcccctcaccaatgaaatccggcctgtcagcagctgcacccctcagcatattggaccagctatcccagaagtcagctctgtctggtttaaacagtacatttacgtttatcatatcactggacaaggaccaccatcccttttattatccaaaggtacaagacctcgaaaactgccagatatatttcagagttatgatcgattgctaataacatcttggtgtcatgatcctggagtagttcctacctcaaatgtgctcacgatgttgaatgatgctttaacacattctgcagttttaattcagaggcatggtctgcatgggataggagaaactgtccatgtcccatttccatttgatgaaacagaactacaaggagagttcactcgtgtcaatatgggtgttcataaagcattgcagatactaaggaacagagtggacttacaacatctctgtggatatgtcaccatgttgaatgcttccagccaacttgcaaatagaaaactcagtgatgcttctgatgagagaggaaaacctgatttggcttctggctcagatgttaaatgggagtacagagtcatttgaaatggtcattgaagaagcaactatagattcagcaacaaagcaaacctctggtgccacaacagaagcagattgggttcctctcgagctgtgctttggaattccactgttcagttccgaattaaaccggaaagtttataggaaaattgctacacatggcctttgcagaaaagagagccttcaaaacctcttacattccagtagaaaactctctctgcaagtccttaactttgttcactcattccaggaaggtgcttcaacattggatattcacacagagcccagtttttcaagtttgctttcacagtcatcgtatgctgacatgggtgttccacttcctgcaaaaaatttaatatttaaagatggtgtcttatcagaacggagtggatggtcaccttcctcacttattgctaatctccatttgcaataatttggttacaccatttgctgctcacactttctgccttttttctttcttaacgttagctttatagtgtcagccactaaaaagcatcctgctgctgtggagcaattcttgctttactaatattaaaagtttggggaacatattcatgttttctgaagttttgctccttattgcacatcttattgcaacaaagtgctttttagcatccagcactgtattttttaccttgagacaatctgcatttcttttataaaactaagtatatactttataggctttatgatgactgttatgtttaaaagcagtcactgtgaaaattgcaatgataattttatatgttagtttatcaaacatcaatcttgtttaactttatattttgttacctatactttgggggatcaagggaagagatggaactcttcctctgaaaatgcttcttggtacttaaagtagtaaaactataaaacagtaaacatccagtattgggagatgatatgatagggcattatgaattcctatgggtatctaaattatgtatgtcaattggacattgtagaaggtatgtaaatcatcatggttatgtataacttaaccttgatttataaggtcttaattcagattatgactattcgttgacatctcatgagaagctttagaaaactttctatttttaaacaccatttatatgtggacttctgttgtcactgactttgggctttatattttcacagagtctttatggaaaaagtagaatttattttccactcttgtagctatagctgctgcacattttcatcctgatttatttttttgtttcttacctttgatgttttcaaaccaaggattgtgattttaggttagaattacatattagaaacattaagactatgtctttggatcaaaatgctttagtgattaacctactttgaagacatactcttaagcaatctgtatcttaaatttatgtgaatacatttttagaaaatgataaagaaaaatggaattacttcaaagtgtttcttgagtcattgattcttttagcatctcaaatgttaattagaataattggaatcactttttaaacttttcaagttaccttccttgggaagtttgtgtagtgttacagtttagtttagctcctcttatagggcaatggtttgctagtttaaaactgtaaccaaatgaactggtcagacaactcatatctaaaacacttaaaatgttagaacgtttgggaatgttataacctaagcgtttttgctgataactttttgttatttatagacatttgtgtatttaacatacttacttctggaaatatatgcctttcctaaaacttaaccacacatccactaccatggcctatgtatagaattgaatattttggaccatgttatctgtggcacagtcagtgctgtgtttgaggtaaatgcagtaacggttagttttctactttgccttataaaaggtagaaaccatgtgtatgttatgtttgtctataaaagaaaaatactaatattaaattatttcttatgactgtgagtcactcacttatttttccaataattgatattgtacattcttagtgccattaggtatgtatgtatgtaacttttacagtttttcagctgaaagttgtatttttttttaatcagggctctttaatctcattttaatttcctttgtttgaatgaactgtagttattttctgtattcctatattaaccatctaaaccaactgtaatgacacgtacactaatgaagaattgaacatttgtatttgttggcagtgagcccagttgttggtgaatttaaagcttaaaatatgggagtgatttgctgctatatttcttttgagagataaaggaggaagaaatggaacctaatggtaatcatgaattttagggaaagtactgaaaaaccatgcggtcccctctggtttcttgtgttgaatgaggcaagagtaatcatctgattcttagctgaagacttctcatactctcaaggagggagagtgcatttttagagcttttagcaaaaatgtgaaaagttcatgtttgcactttgctttgtgaatttggcttcattttacttatacattaactcatgtaatgtcttcaatcttacaagtattgatccatttcaacaaaaaggtaaatttaaaatgcagactttgttacttgtcaaagaagattcatgaaaaatttatatccaattattttccaaatagttaatttaatttggctttttaccacattccttcctttctttcccgacttctttaatgtaatttaaaccctggaaaacattctttagaaaccaagaggaaaagaagaacacatatcaaaaaagacatataacttaaaatggtacatttcacatctaaaatgggtttgaagaaacgcaactttatatcattaaaaaataagatcatctgatttcctttatttcttttttaaattatgtaatcagatgattttatattttttggggggggcggaatattggtttcttttacttgatgttttcagttttctctggcattcaagtttcttttttgtgttcagtgtttcaaatacaatttgtatttaaggattttaaaataccaaactgtaaatgagtacagtggatctttttctgttaggatgttaatattatacaatgaaatctataaagtgttgtcaatttgatcattgacacatatgacacgtttacaattaaactgtggtgttgatcaagttaaaaaaaaggcggaggccttccataagtcatttcaaatggactaagctttaaagttctctttggagccatcctcacatgcaaaagggttatgagtaggaggaaaactcaggcctctgaggtctcctgaaagagttttgctaatgtcacaactggctttctatgttatctgaagattgagatctccatgaagagtgaagataggtagtgcttaaggctgaggcattacctcactgggtcaccttagctgggaagggaggtcagttatccccttgcaaacattttggtaatccaaatcttgggatgatttctttaagtaagaatttagacacttccaatacttttcttgtccttgtggggaaagcttctatccacctggtgaaagtgtttataaatactagcaaatattgtagtcccctgtaaggtggcatctgggttaaatctgtctgccagtcttcactatggtatgttccgtggtgttgtacaagtttaagcagggagcggggtatggggtggcttcctgattggtaaatctttttatagtttagaacagtcccttccccaagaatatttaggaaactaatttgaatggaaaatcctgtcccaaatgtgaggaatcatgaaaatgttaaattatttcccatttgtcagcctcaggaatagagtttgttcttttctagcaagcgtctagaggggtcttactggaagccttttactcagtccctttaatttccttgggtgtatagtacggttccactgacatggatgacctggtagtagcgcagcagcctgaaataccagggtttccttagctgtggccttagctgctctttccaaaagggaatttcctctaataagaacagtgtctcccttctggtgtcccctgcagtgaatacttgttatttctttgggaattggatggcatctaaaagttccaagatctgagtaaagttgtatgggggatcccttggctcttgatagtcccctttccttccctatggttgcatgagcctgaagcacccggaaaccatacttagagtcagtaaacacattgactcttgagggttttttttttcttttttgaaacggagtcttgctctgtcgcccaggctggagtgcagtggcatgatcttggctcactgcaaactctgcctctcagtttcaagtgattctcgtgccccaccctcccgtgtagctgggattacaggtgcccaccaccatacccggataatttttgtatttttagtagagacagggtttcgccatgttggccaggctggtctcgaactcccaacatcagatgatccacccacctcggcctgccaaagtgctgggattacaggcgtgagccatccaacccaggcttaagtcttttcacagttggaaggtcctgattagagcagctaattctgctttttgagcagaattctgagaaggtaaacccttggcctcaatgacttcttgttagctaaccttcctttcttactccctcatgaataaagctatttccatctctaaaccactcaacactggggttagacaagggcttgtcttcaaggttggaccttctagagtagatctcttccatggtttccacccaggagtcaatgagttggggatctgtttcttgggatgtgaggtccagcaacagagtagcagggtttaaaaatcagcatactttaagggtaacatctggggtgtcaagcagaagagcctgatatttaagtaactggccccctattagccatgggtatacttttgcctctaggaccctctgtactgtacttcatggggtggtggggggcgggggtggtatggcatctacttgttgtcccaaggtaaacttactggcttcttccaccaatagagtgatggtagctacagatctcaagcttcctggtcactcagctgccacctggtctagctgtttagagaaataagccactggtctgaggcaattcctgacccttcgagttagaacatccaaagctgtcccttgttattcatccacatagaggatgaaaggtttttctaagttcgagagtcttgaagcaggggctgtccctggcttttcttttaaggctaagaatgccttttgacagtctccattgcaattcaaaggcttatgaccactcacttttggaggttcatagagtggttttgctatgagcccaaacctgggaatccaaacccagcagaatccagctattctcaaaaaagaatttgagggacctggagtgccaggatggtctcttttcatccctgggtcaagatcctggtcccaggagtgagaatgtgtcccaaatacgtgaccctttggacagaaatttgggcctttcggggggatacctgatacccttgttttgtttcaaaattaaggacttgaagttgtatgtttctcagagtcttcccctagtagggctggaaattaataggtgatacacatatggtaagagggatccattaattaactgtagttcccatacctcttttgccaatgcattgccaaacagatggggattgtcctaaaaccttggggacaggacagtccaggtaagctgagatgcagcatgagtgtctggattagtccattcaaatgcaaaaatgtattgggtgtccaggtgtaaaggtgtgtgaaagaaaacatcttttaaatttaatactatgaaccaataagcatcttcagggacttgagttattattgtataaagattaggaactattgggtgactggaactaatgcctcattaactgccctaagatcctgaacaaatctatattccccgtttggcttattaacaggaaaaatgggggtgttacgttgggactgataggattgcaataatccatacttcattatcaggggatggatgccccttggagccaaaggtctaaaaggatactggatttttctttttttttttttttgagtcagagtcttgctctgttatccaggctggagtgcggtggcgcaaggctcactgctacctctgccttccgggttcaagcaattctcctgccacagccttctgagtagttgggattacagatgtacaccaccatacctagctaatttttgtgtttttagtagagatggggttttgccttgttggccaggctggtctcaaactcctagcttccagtgatatgcccaccttggcctccgaaagtgcagagattaaaagcatgggccaccacacttaaaaggatatttttttccccatagataattaacactgggtttcaaaataacctggactgggagaacatttgcagttcttccaggaactaccatgtcacaagcagacgggtctacttgagaagtaatatttgatggaaggaatgacttttctttatctgtgttaagacatgaacttagagctaggagaagtgtcccttcccagcctgtggccttctcttgaggtgctccaaattgaactgcagcctgttattgggaaagtaagtctcttcccagcaaaggaataaggcactcaagactaagcaaaaatctgtggaaaaacatggttccccacagtgcaactaaaggaatgggtgaatctcctagcttttagctggtcatcaatcctcattacagtacaggagtgggaagacagtggcaccaaggactagatcagaactgagaaggcggctcgcatatccaataactcaatatttttacccgccatgtcaagaattacctgaggctcttctgtagagatggcaaggtgtctggtggaagctgtagggaatcttgggccctgtcagtcctctgttctcttagccattaggggtccaagaagctcagactccgtttggagactgaggcagtctttcctccagtggccctcttgcttacagaaggcacactgattccagcctaggggatgatgagctggcttttgtctgggcatcccaaagccactcttgcaacactttctgaggatgggcagctcaaaagcagtaggaggctgaaagcagctgcaaacaattgcattttttggctatttcttttggttttatcctcttcctctgccttgtccctattgttgtaaactccaaaggccatgtttaagagttggctcatggagtttggggtcccattcctgccttttgtaacttcctcctaatgtcaaggatagattgagtaatacaacgcatgcccagaagaccccacccttccgggttgtctgggtctacattagtatatttcctgagtgcctcaaccaagcagccctaaaacagaatgggattttcatccttccactgagttacttctctatccttgtcataattaactggcttaatcacacaccttttcatactttctattaaacaagttagcatgtgatttctatgttcaagttcttgggaacccttctggtaatcccactgagggtctctatgtggaactgcatctccccctacataaatggtatggccttggatatgagcagctactctaactgcatattcacaggccagtacccagaatccctctcttctcctctataatacaggaagaggacaataatatttgcaagttgtgccaagttaaatcaaaggacatcatcaacctgacaaactcctctataaacttccctggatccttcaaaaaccagccatatttctccttgaagaaagccaatttggacaaaggaaatggcacatatactctgattgttcccctatctctgccagctaactccagcaatggacacagattcaatttgaggggctgatagagagctccactcctggtggttctggttgggcttacttccttgggcagtggggatacaggctggagctagctaaataaaagggagggttttctgatgacattggggtgaaatcccacactggagaactggcaggacccctcgcagaactgggggactgagaagaccctggagagggcatgggccctccagggggtgccgccaggaagggagcatcgaggatatcccacgcggtttcttggtgcctggaagtaacatgagccagacacatcctgcagttgactcttaagtcagaatcctggtagggggccgtagaagcctgtacgtaaggaacttctccccattttccttcctttttactgaataagtccaattgtaaaatagtatgataatgtaaagaacaagtttcaggccaaatttcttgttctcccaagaaaattgtttctttttctttgagccatctcatttgaatttgctccaattgccttaaagacaccctagtggggagtcctttgggatgctcgcctttgtccccatgtctaacaaggatctctactacacccagaagtttttctaagtctagcaaaagctcagttactttccctttcaaattcccacctcctgcagagatgtaagtacagttagcaaagtgttatgaaagtagattatgaaatatgaatgcgaagtaaaatgatgggtctgaattccacagagtgaagaaagcattttagtttgggcaaagaggggttaaaagaaacaaggtgatcatggaagggaggaagggaaagcatgaacagcgttgtccagactgaggtgccagaaaatctacccagcagccacagagactgaggaaaattatttgggcaaaatgtttggatggctgctgcttgtctgccactatgggtagttgtcacttgggccaggggtccaggaatccctggtccctgtgaccaagagttcaatatgggcttgagcaaagtcacgtaggagggggcccacaactggctgttatggaaaatcgtaatcttttaatttaagggcggagaagatgacatccacactcctccagcgaaggagctctaatccacaatcctatagggaatgtcaatgctgaaaaccccagagcatccagggagaggccaacagtgacagtggaactctcaccacaacgaaatgccaaaaacccagagtacccaagtatcagccagtgatggtccccacactgaatgctgaaactgcaggggaggcaatggtgaaccccaaaggccaagttaggggccactgaacaatgtgactttggcatctcagggtcagcacagtaagggacttttcacgaccaagtgtcctgccttaaacagttcttgactctgtcctgtcctgtcctgtgttatatcatgtcctgtcccatcttgtcttgtctttgtggtcaccagatgatgcaaggaaggacaaccccaaaattggggcttagccaaggagagttcttggctttgcccaggtaagaattcaagggcaacccagcggtgaaagaaagcaacttttgttaaactggtactgcttctcgtggaggaaggctaacccatgggcagtgtgtgggttgctagctagctgtatttatttagatgcttttaattagatgctaattaggaagtgggctattcagaactttttggaaaagggatgaggagtttccagaagcatataaggtaacttcctggccattgccatggcatgttgacatggcatttataaactgtcatggcactggaaaggagtgtctttatgctaatgagcagtgagagcaactagaggtagcttttgtctccatctgctggttttggtcagcttctttactgcaccctgtttggaccagatcctgctctgatcaactgggccacaaccgcaaataagtcctgccactttcctacctcagtagaatctctgccaaagaatgatcttgaaagtttgctgtttactcatcatctggaaaaatcttcctgtataggccaaattcccacccttgagatttctgaaggaccaacaagtaaaaacagtatactccaatgggactgttagatttcaactaacttactctcctttggatttctttttctgaaaataaattcttcacacacactgacttgtcttttgcaatccaatgtaaaagtgggacatcttcttcagaagctttgaaacatacaaattagcctcaaacttacctaccagacttccaggctagaaggctgattcatgtaagaaggactaagaagacacttcacccatatcctgggtaacaggaggggatcctttagataggtttgtacaccaggctggtaacctacactttcttctagcagtgagaggtactgagatccgtcaccccctcctgcaaggccaagacccagagagagccaaattttagcctagaattcagccagctcttcacagtctcctatgttttacattttcctccacaatcatttactttgaaagacttcaaacctatagaaaaattgaaaaaaaaagaactcctctacaccattcacccaagttcaacagttaacattcctttaccttttttctctgtctacacacacctacacacacattcatatttcatagtaaatgcagaccaaaaaaactccacttcatccctaaatagttcagcatgtatttcatgagattaaggacattatcctatataattataatacaattcaattatcaaacctaaggatattaacatttattcaataacattatctaatatatagtccagatagaaattttctgtttagaaaatgtcacatctatacacatatatgtgcatgtatatagatatttatgcatacatagtgtgtgcatgtgtgtatgtatgtgtatatataacacacatgcacattacatatgcataaatgttttaatttaataatatttatatgcatcaatatcttaaagatatatacgtatcattagctggaagctgcctctatccatatattaaaggtttctccatatgtagtgaactgtaacctaactggatgtgtaaacaacctgtaacctactcttgagccaatgactgagttttagccaatcaaaggtggccaactgttcaaactgggttcaaataagacaaactcagagctgtagccaatccgattatttttgtacctcacttctgttttctgtaagtcactttcccttttccatccataaatcttcttctaccacatggtagcactggaacctctctgaacctattctggttctggaaatttctgattcaggaattcttctttgcttaattaaactctgtgtgtgtgtgtgtgtgtgtgtgtgtgtgtgtgtattatatattatatacacatgtaatatatatatgtatgtgtatatataatatttatttaagagagagagagaagtgacttgtggtactgatgttgcttccctaggttccaagtaaagttcctcaattgcactttacttacctagagctgtccctccatttctttgtccttgttgctaagtttttgaagtggataggctagttatcttgttcaacatcctgcattctgatcaaactaaacatttttggaaagaacagaatataggaatttgtgcttcttaccactcaacctgtcagaaagcaagtgatgcaagaacaaaatattgtgaatatgtttacatcgaaagtgttaaagaaaactcagcatctgccagcaagtttatggcgtgccacggtggtatagtgattggcactttgtgttgtgaatgcagaaccttgattccaatccaaaatggcagtgtgtggcatctttttggggagaaactgagctgtcttttggtttgttttcaatccgtgcactgactgagtcctttagcagggtttaccactgactcctgcaatgcagtgcagtcaggcaaaaaggagaccccacattgcacatacctagggcccaggacatgccctatgtctcaccattgagcagaaaatatcccaaagggtaaaatgtcacctttcaaaccgccatgttggtagcttccactaatgcagtggtgtggtcataactggtttttactgttccttacaatggctgcaacccttatttgtgactagagaacaaggcttaccactgaattgccagcatgatacagccagggccatcaaaaacacacctgcactagatcattgggaactttggaggtgccttacatctgggcatgcattgaaccaccacacaaggtgaaatgcctcttctcaaagaggcttgcctgcagtttccactaatgaaattgtgagtcatagctgttcttctgtttgagatattaggagggattttgtggggggtgaggggggatgaaagtgagcttttactgagtttaaaataaaatccaaactccttgccatggtctacactggcttgtctccatcttccatcccccaccccccatgtttatgctaaagagcagactattgaaatgtaattcacacagtgtaaaattcaaatatattaactaggacaggttattaaatattgacaaatgaaatcatcacccagatcaagttatagaaaatttccatcatcccaaaaatgtctgtggatgccaggcacggtagctcatgcttgtaatcccagcacttgggaggctgaggcggaaagattgactgagcccagcaatttgagaccagcctgggcaacatggcaagacccccatccctataaaaattttttttcaaattcaaaaaataaaaaatatttaaaaaggtccaagagtccctttccaggcaatcccacccttctccccttggtttatcactattctgatgtttatcaccatagattatgttgctctcttcttgaaattcatataaattcactttttgtgttagctttttttcacatctttgaaatgtatccatattattatatgtatctagtttatttgggtgtaactggtgagtgttatccaatatgtgaatacaccactgttgatggacaatttggttatttctagtttggactattatgaagaaggctgctgtgcatgaatattattgtacgaatctatttatcaacaaatattctgtgttttcttagattttgtatttgtctctatttggcatctattcaccgcagaacaattataataactatattttcttattttctttatttttttcttaaaacaatttattgatgtatgcctggtatactaaaagctgtacatatgtaatgaacacaatttgctgagattggaaataagtatggacacattaaatcatcaccacaggccgggtgcggtggctcacgcctgtaatcccagcacttttggaggccgaggtgggtggatcatgaggtcaggagattgagaccatcctggctaacacggtgaaaccctgtctctactaaaaacatacaaaaaaaagattagccaggcgtggtggtgggcgcctgtagtcccagctacttgggaggctgaggcaggagaatggcgtgaacccgggaggcagagcttgcagtgagtggagatcgcaccactgcactccagcttgggcaacagagcaagactccatctcaaaaaagaaaaaaatcatcaccacaatgcatacaataaaactattcagctgggcacagtggctcacacctataatcccagcagtttgggaggcccaggctggtggatcacttgaggtcaggagtttgataccagcctgcctaacatagtgaaactccatctctaccaaaaatacaaaaattggtacagaataattatacatgtttataggagtacatatgatattttgatatatgcctacgatgtgtaatgatcaaatcaggatgtttaggatatccatcatctcagacattttatcatttctttgtgttgggaacatttcaaattctctcttcttagctcctttgaaatgtacaatatactgctggtagctgtagtcaccctactgtgctgtttcttttctgagattccacctaaccccttgatgttccaactgctgtggttgtctaaaactttgtcctctgttcctttaatctaggaagacagtttggttttgtattgtaatttagctaatccaagtaagggggagcaaagtttgttctataaacgaaaaataaaatcctaagtcccccaactgactaaatggaccccccgttggccaacgggaccctaggcaaaccttataaactgagtcccaggccaagaaggaacgggaggccagacaagcctcattatattcccacccttttgcaatttagacaaaactgaccaacattaatgttatcatggagatcataagactgacggaacagactctttatggcaataagacaccaaattataaataggacttaggaccattccgggcaaggattaactcacacaccccatatatgcaaagaataaactatgttctaactgccacaaggattttctctagcagctaaacaagcactggccttgagaatagggagtgttgaagcacttgctgctcacccctcaccagataccgaaccccgctgttccacaagccataactacagccttgactgacaagagactgatttcagtaactttcttctgatgagaagaccagcgaccatggactggttctgtcagttttacagtatctgtgcatttgagtgcctttgtgtcctgaaaagacctttgtgtatagggcctaattgtaatgcatttaaatgctaagtatccataacaaggtgaacaaggttgtatattacgtgaatgtttgttcaataagcatgcatcaggaccccttcacaaatattcataaatcctcctataacttgttgaatatgtattttaggcccacccattcaacttaaattcctgtcttgcccctccctccctcaaagtgcctgcttctgggcttcccgcgattcccagcctgtcaggatgaccaccttacatgctgtaaccctttagaagaaataaattctcctctgtaagctcacaaattgtatggtttttcagttaacagccctctgctgaaagtttgcaaaatgggatactcactacctgccattcttccatatgtccgcctgcttttgttcagtcttccagcaccttcaaattatataatatatatatgaaataaatttttctagtttatagtcgttatctgtgggagagttactctgaaagcagcaagaagccattaccagatgcagatctcattctgtcagtaatggcaacccagcaaatagggcaggagccccacccaggtgtggatcaatgcatggctgtataaccttgaacaagctgcttagtcgacctctgaagtcagtactgctgtatgagaaatggagatatgaaaagaacaggagtgctagggtgcccaagggagaaaagagtaggtaacaagattttcggtcaggagcatgagaaacagggagagggtcgccattaactccccttcttcaccagagttttctggcacccaagactgcagaaactctcctgcagtgggctttggggcacatcgcaagttccagtaacaagggctaaggtcgcccgcttttggagaccttacaaagcatgtattccctgaccaggaatcgaactcgagctgcaggcggtgaaagcgccgaatcctagccactagaccaccacggaaacaacagcaagcacttttcattcctcttgccttccaaaggtttctccaaaaggtgaacctgtctgcaatgctcacgaagcccgccagatgcacaagtcaaaactgatctagagattctgaagtacgctgtgctccttgagaagtgcggagccactggaaccacaagcagcttcagacaggaaccaatgaggccatcaaaaccctcaacagaggcatctgtgagttcattgtggtggctgcagacaccacgctgcaagagagcattctgcactcccactgctgtgtgaagagaagaatgtgctgggcctgcctggaatgtttgcgcactccaggcgggccctggggcgggcctgtggggtctccagtcctgtcatcacctgttctgtcaccatcaaagaaggctcacagctgatccagtccattcagcagtccgttgaaaggctcctagtctaaacctgtggcgtctaaacccgtggcctctgctgcacaatctctgctgactcctccccctgaggttattctcagctactttctattgctataaaatattatagtactaaatctggtttctggggttttgtatagtttttgttctgttttacagggttgttttcccccttctccatgcccaccctttctctgccatcctgcatcctcttcaactctctattgaaaaatgaacaaatgttcagaacagaggaagtagagtggtggcaccatcaaaggcaggaagggccaggagaacctgatgggagcggggatacagacctggttctagcttccagtcttccagtcactaactttctgctgtgtgcagggcacaatggaagtaaacaccacccactatatatcccctgtgcctggcatacagaatcattcacacatgttgaccgaagggtttcctttgcttctaggggattatgtatcattttgggaggaagcatgtattctgtgaggttgtttagtttatgtccaagcgccatttactaatgtatccctgctctttgctttcggtatgtatgttcttcctccacctgacaattgtgcccccaatggtggccaggcagcagcataccaaagagatgtgctgcaagatttcagaggtgggtgagtgagacatgggaaagtggactcaggtcttgaaagagtcaggagtggccagggcaaagaacatgaactggtgctggaatgaaggattctgggaaggttgtggagacctggctggtagctagagcagagatgatggaatccaaggaaacaacttctctccggtgaatcaagatttcttcagtggacacttagtcccagctctgatagcccttacccctgtttcctgccacagtgtgggtcatatgtattctttatcatatgaggagagtgctaattaatgtgtcatttattttgtgagcatgctaatacatatattcatattccaatttagtgaaaaaaaactgatctagagatgccccttttcgaggtgacagcatggctctggagagatggccacaggaaccatggcagtggaccaggttgctgggagaaggcaaaaggggaggcacccaagctgagaaggggctaagcactcagcccctgggaccaccaacagcaggcctgagacacatgcaggaaaccagacagcctggatgaaatttctttcaagcaaggccagtggtccctgacagaacaccagaggtttccccctaaatcctttcgcatctgtaccatttccatcttagttggagctctttgttctcatccttgcaatacgcagagaaaaaaaaatcacaggttgttgattgtttgaagatagggtattgctctgtcactcaggctggagtgcagtagcatgatcacggctcactgcagcctcgaacatccgggctcaagtgattctcccacgtcagcctctggtgtagttgggaccaaaggtgtgccaccacagaggcagggttttgccattttgcccagaatggtctcaaactcctgagctcaagggatcagcctgcctaggcttcccaaagtgctgggactacaggcatgagacaccttgcccagccaaccagagttctttttgatgccgatattttactcggactccacatctaggtaggaattcatgttttcaagtacggacattgctctacacaatcctctcctttcctgatcactaaattagagtaaatcactgtcctgaagaaggtacccttgggagagtgggttggcctgtctttccaccctttcttgactctgccctcaccttcaagcctctttctggcctgtgttcaaggtccagaggcatgcttaagacctctctgtgtggctcttcttgaagagtcaggaaccccatacttcctgttcagcgggcagagaagcttcaagccgcacagttttgggtatgctaggatcccacaaggcacagatgtgcagtggcccacgaagtgagtttgtgggtctccagttacctgcagccctttctgctcctgtaggttaaagggcaattgcctttttttttctgtccaggaaggaccccagaatgttctgagtcagaaagacagtgaatcctctcctctgggtcagtggggagggagagagagagatttcagagggaagaaagcagaaaaagatgtcacaaaattgcctaatcaaaagttaccatgatgcctgcctcatctggaactgggctcccagtctctagtgagggagacatagtccagtccagtcccagtctccagtctgagccaaagcagaacaaagctggacactgcagcctggcatccaacgaacattttgtcactttccccagggtgggagcatttgaactttggatgtgaaggaaacatggtaaccactgcagtaagaagagcaactgctggagaaaatggcactttcttccccaaatttgtttttacactcatgtctaaggaacaccttagaaaccacattaacatctttcagcaaaaggaaattctgcctgttgatcttttgctgtgagacaaacttgaaaagttcacagacactgcctttctctgaaaactgcccttacctctttgttataattcacttcaagatctgttgagtaggaacatcaaaaatgcaaataaaaagtttcaagtattatgaaagaatgcaataaaactgcctttaaaaaaaatctcaagatggaggtggagatcctgtgatcatgaaatctgaataggctgctcttgtgtccttcagtggtgatggctctgaaacccttgtgttttatgaacttcatgccctggtcttcaaacgaattcagtgcaggccaagaagcacagtttggcctgggttggatgctctatattttcaaagagtgaaatgtcttgagacacagcctttgctatagtacctgctaaaacttcaacgtgtggataaatatagcttacattgaatcgaatagactcagcgagagtggcagtgaaggatgccctctggaagattcgaggtgctgaggccaaagggctagcaaggaaagagcgtgcgggtcaggcccttcaacctggtggaagagcaggcagggagggtcctatggttcctgggaggacccgaagcatgatcgcctgtcaagagccaagagccctaatggccagcgccggggaaagggcccccgaggggcagtcagcagccctgcaggggcggcgttcacactcctgtgtggcacgggacactcatggctccaccagctcctgaagcttctgggagccagagagtcagcagggagaatcccacacacgggcactcagttcctggaaaccctgcatgagatgcgggatcccgaagccagattgggggtccctagggtcttggcttcggggctaggcgcggaaccgtaaatgagggttcagcctgtctgcctgagggattgtgtttcctgccgtatttatcactcaaattttgaaaagcagtcgaatttgttatattggaaaccctagtagttaaaaacagcagatggtaacatttcaggaatatgtcttgtgccaggaactgtgaggggtttctgtagtgtagtgattacatgttcgcttcacatgtgaaaggtctcaggtttgggacctttcatcatcaacatgatgaaaccccgtctccagtaaaaatacaaaaattagccaggcgtggtggtgcatgcctgtaatcccagctcctcgggaggctgaggcaggagaattgcttaattccaagaggtagatgttgcggtgagctgagattgtgccattgcactccagcctaggcagcaagagtgagactacgtcttaaaaaaaaaaaaaagaaagaaagaaaagaaaacagaggactttaaaaccgttattatgtcaatattctatgggtccaaagaattaagcagaggtatcaaacatataaaaatggtcagaatcaaactttggagattaaaaactacaacatctgagataataaattcactggatgcaattaacagcagattagacactgcagaaaaaaagattatgaaacacaaagccgccgggcaccgtggctcaggcctgtaatcccagcactttgggaggcggaggcgggtggatcacgatgtccagagatagagcccatcctggctaaaacagtgagacccccgtctttacaaaaaaaaaaaaaaaaaaaaaaaaaaatatatatatatatatatatatatatatatatatatatatatatataaattagctggacatggtggcgggcgcctgtagtcccagctaatcgggaacctgaggcaggagaatggcatgaacccgggaggcggagcttgcagtgagccgagatggtgccactgcaccccagcctgggcgacagagcaagactccctctaaaaaaaaaaaaaaaaaaaaaaaaaaaaaccgcactgaggggaaaagtcaatgtgaaattctacaaaagctgaaaattcactaccaccagccattaccacaaaaaaaaaaaaaagttgaaggagtcctccaggcagaacgaaactgacatcggatgaaaatctggttgtacaaaaaaaaaaaaaaaaaaaactagacatgacatctaatagacgaatatataattttaacatctgactgtttagctgggcgtggtggctcacgcctgtaatcccagcactttgggaagctgaggcaggcagatcacttgaggtcaggtggttgagaccagcttggccaatatggtgaacccctctctctactaaaaatacaaaaattagtccggtgtggtggcccacgcctgtaatctctgctactcaggagtctgagtcaggacaatcgcttgaacccgggaagcagaggttgcagtgagccaagattgttccactgcactccagcctatctggaacctagtttgatctggagggatcttattttataggaggcttggagggggaccttttgctttgtgtacttataggatgcacaagacacaagggaacaatctctcactttttaaatacagtgataggcctgaggagaaacaactgcaattttttttttttttttttttttaatgagatgggattctcactggtcttgaactgagctcaggcgaggcttcccctacgtcggcctctcaaagtgttgggattaataggcgtgagccaccgcgcctgaccacaactaaccaacatttaaaagcacgtccctgggtaggctcgaaccaccaactttccggttaacagccgaacgcgctaaccaattgctccacggagataacctcagttggtcgctttcatctcaacatagattaagcaatcactaaactctaggggttgccattcgctttctgcaggacaactgtgcagactacaaagcttcggaaaaccggagaggctgagtcgactaatcgtgttgttgcacgttagaaacgcttgcattgcctgactctgaaaccagaagggcggccgaatggccttcaccctccattaaccctcgcctccttcagaagccagtgcctctggaaatgcctggatctgcgaccccagcctgagcctagtagggcccaagggaagctgaacgccccgacggctctcatggtaggtagctctttctgtttttttgcgccgccttcaggcaatcatctactccgcttgctatcccctcactcaactcggcttcagtagatggggttggtggggcgggagtgggaaagaggcaggggagtcaaaagggaaaacctgaaaagaaggagggagaagaagcaggggagaccaggacgagacaatgggacagcccaggatgccggtgcagagggcagcggctggatgcagagaagatgggacacgtatcagaatggactggagaagacgtgagggaaaatcacaagaacctgtagctgcccaagaataaacacgtaaaaatcgcataaatgtttttacattaaaaaaaaaatcgggagaccgggcgcagtggctcacgcctgtaatcccagcactttgggaggccgaggtgggtggatcactcacttgaagtcaggagttcgagaccagccgggccaacatggtgaaagcccgtctctactaaaaatacaaaaattagctgggtgtggtggcgacgcttgtagtcccagctactcaggaggctgaggcaggagaatcgcttgaacctgagaggcagaggtggcagtgagccgagatcgcgccactgccctccagcctgggcgacaaagcgaaattctgtctctcaaaaaaaatgcataaataaataaaagaggggtggggaagcaaaacgacgggcagtaggtgtggggcgcattgggattctatagtggttagtaccctgccttgtgcctgcagcaacctctgttctaatctgaatcctggtacagtcagactctatcttggacccactggggcgaacccacgagtcttttggtttgcttttaattcctgcaccagctgcggcctttatctgcagccagaaagcagggtttaccgctggccccacagcgccatacggtctggggaaaagaaggaaacccaatagtacacaaacaaaggcccaaagagaaaccttccaagtgctctatgcctcacggtttagcagaaaatatcaagcaactctcaacctagctggtctgtagcttccacaaatgaaatactgtattcattgcagcctttctggttgagatatttcaaatatttggtggagcttttaatgagacggagagacactctcgagtgtggaagaaaaacatgagggggtgtgaggataaggcgactttaggacagaaaaaacaaagagacaaggaagccacgtaaacgttttcgggtaggcgtgaggcgatgtcagttttgaaccccgtttatgttaggtagagagcgcagccctcttctagcacaaacaccgtttcccacattgaagaaatcacagagatcagcaactctagagtgcgatgaagaagcttcactctgggagaacccccttcgtgaccacggtctctttcctgccaggtaagtgggaatgagcgcatgccctgcagggacagcacagcgtcctcgccctggtcggacgctcagggtcaccaccctacccactgcccccttcgccattcttccaaaccactctctgccaaagattccaccgacagtcaccccacacgacaacccaggccgcctttcagcagtggctcccgccccgcaaccacgcgccctctcacccccgcggttctgcccgccgcctctgtccagtctgtgcacttcacctccctggctcccgctctcccctgagcttacagtggacgcggggttcttccaaacccctcttgggaatactgaatggaaaagggggagcgtgcgcaagtgcttggtagagtgtagacattgtgggatttgactgtggtaccatcgctttgacgtcctagtgctgatttttacacctgcattctgcttagggcactggcaacagttttccgtttgtgcctactccacctgctgtctttgttgggtcagcgaacatcgcctccctctaccgctcaatcagcaaaagggaccgcccttgaggacctcacccgccgctcactcccctcccaacttcgcgggcatcgcctccggtcgcctcttccgaaggcctaacgagcatgttagctgcgaacggaggtgaggaggctccgctgactgaccggtgcccacgtccagggcacgcacaaacgccatgacttggcttggcctctctcttagttattcacagctcagcccgataggcacctctggggcggcgacggcaaagagggtgcgcttattaagtgcagctccacggggactggcctctctgcacggctgtgtacacctgagcgagacgctcagtcgctctctaaagccgcttctgcggatgacagacacggagataaacgtgagaggtggcccaccacgacttgccctcctttgcccgggtttgcccctcgctgcggaggctgttctacatctggcccttggagcaggccggctgacagcgtggtaaaggaagatttctgcgggagggcggccagtgcaaaacaattccctgaccgggaatcgaacccgggccgtggctctttcagcaccgaatcctagccactagacaaccatgcagatgcggaaagctgctttctctcccttcttcgacctgaagcgacactttcctgtgctctaggaggacttgggtcttgtgagagtcgccctttgctcctggagtcgtctcacaaggccgttcactccctgctttcttcaaaaaaagaacctgcaggcgacacaccaaggactccacgagggagtcctgagtactggagcgagttgcggccacgcggccgcagctcaccactggcctagagatgccctttgcgaggcggcagcaactgacaagatggtcgcgggtcgccgggtccggagccgcccaccaggttgccaggaggaggcgggagcggggaggcgcccgaggtgagacaggggcaccctctgcatcataaaggacccagaccccggcaccctcaacatcataaggaatcagacggatgcggaaaccgagacgggctggataggaaactctttccaggaaggctccggggcactcaactggtctccaaccttcccctgcaacctgtgacgcctgccattttcccattttaggcgatggcaacgcaacccctccgtttgctctgggcaaaacttcgagagttccctctgaagctggagctttttcctcagatccaagatccaattggtcaccaattcgtgatttccgtcggccaagtgcgtgggcattgatctacacgcgagtttctccacctctgccgaatggctacttcggggtgggggaggggccctcccgccgtggattgcaaggtgtttagcagcatctgtctcctccgctgactagacacatgccagggggataacattctccctcccgcttcccccagccgcggcctagtgtcccagcggggttgggagaggcatgtgagggcgaagttgccccctgttgagaaccattgctgcgcgtagtccttctctctgaacttgtgcagaggactctccaggtgaaggctcaagggtggatccagctcgagacaccctcgctccccctcacagtcggaccttaggatttaggctttaacatctccacatcatgagattcgaaacctttaggtcttgtcttccgttctgtcctccaaatcggcctcttccgagcctgttgaccagggccagccgggcagagggctgggctcgctcaacgaggctcctctcgcacctcctggagcttcaggcttctttccgttgcagagaagctttatgggccaattcgttcggcatccccgggggcaggtgcgcggtgcgcggggaagaagaggatttgactgcggttctccacccccggcgcccaacctccaccccggtgcgcgcgctcttccaggctcctgctggtcccacttgccaggagttaggtctcaggtcagcctgagctcctgagacgcccaggcccggaaagacacgtaggggaaaccatctgctcacttctgtcctgtccggaagggatccctttctgacgggaaagaaaggcggtgagtcctgtcctgttgagtaggcggaagagagatcaaagggaagacaagaaaaatcctgtgagttttcaggatctaaagttaccatgaggtcgacctaacctcctctggaggtcctcccggtcctcccgtggctgtcgaaggtgaatctagcttccgtctccagttcgccaaggcggacaaagccgacgacaatgggcctgtccactatcttctttcatatgcacaaaatgtcagctcttcttgtttctaacttgcaacatcccacctgatgaccagctcagcaaattagagaccctccatgggattccatctctgtcttagttcgggcttccataactatataccataaactgggtggctaattcacgacagaaatttatttctcacagttctggaggttggaagtccgagatcaaggtgccaacatggtagggttatgatgagggacttttttctggttgtagactgccaccttctcattgtatcctcagggggcagagagagctccctggggtcccttttatagtggcattagtcccactcagactaacgggactaaatccagacccagttattgcaatgtgtgcaaaagaacaaggacttgtactatctgacttcaaggcttactataagctattacagacaaggcatcaggagggacaaatagataaacagactgagttaagagacctgaaactgatccacagccatacagtcaataaatgagctttcaatgaaagcagttcaatagaagaaaataaatcatttcaattaatggactttcatatggaggtgggggagaccaacaatgttattctccctcacactacatacaaaagtaatttgaggtgcattatacaccaaaacttaaaagttaaagatataaagcatttcaaggatactctgtaggtaaagattagcctaccaacaagtaggacactgaaaaaatatatataaaagacatgataaattagacttcatcaacattagccataccttctcatcaaaagataccactaagaaagtgaaaaggcaagcaagccacagacagagagaaaatagtcacaaaacgtatctgacctccacatcctgtaattagaattattgtggtctggtacactgcacccagtttctgcaggagtactttctgggtgtctctaatgagtaagagagggccccatgggatattcctacagttcccagatgaacagtgggaaagactctacgttgacaaaccccggggacctgaaaactcaggtcctcaaggagggtagaggatacctggaccctgacccagacccctagatgggctgtgccaagagacccagcaagggaagggattccctcctgcctcaggttctctgttcttctgtggttagaagacctgaacccaactccctctccaagcagtggagatagggcttttccaagggctggggatcttgctgtcctaaggacagctgagcaagggggtcgaggaggagcttgggtggtggaggagaggaaaccgggtaagatgtgtgaagcagtcggctataccaggcacagagaggacccactgggacacaagagcctgcatgtgaagccaggccttgggccaccttgttcctcaaaggggtgcttacttccatgggatcttcaaagggactgtggaaagagaagccttcagcccacacctctgaatgcttttccaccacagcatgccctgtggcctgtatcctgctggtgtggaacagtcagacccctgcagggctgcagagcctctgtactgggcggcatcccagcctgagtgccagagctcagtgggcaggcccccgagcaagcagagaggagggcaccttttggacagaacctgtgggacaagagcgacgtctcatcctttcaggttcctcacaaaatgacagtcaggaagatcagggtgcagacctgatttcccacgaagggctgaaagcagacaaccggagggagagcagcacctgggccaatgaggtagaagacagaagaccacagtgtacttctgccctcaacctcaccccctcccacctacatcctccacaccccctgaccaccttcttcagaaacgtaataggaatcaagatcccccctggcctggttgctatgggaggcacagtggcctgatggagcctgaggcaggtgtgggaagatgtggattgtctaactggaggttgggagtccagggtgcagaaggagaagcttggagtgcaggatttggtggtatgtgtgtggcagtaggcactatgttctaattgccagtttttttttcttcttcctttttttctctagctaaacaagcactggccttgagataagcaatgctgaagcacttgcagctcacctattaccataaactgactgagccctccctacacaagccgtaactactgctttgattggacaagagactgatttcagtagttttctcttgataagagaccactggccgtgggcgggttctggacagtttacagaagctatgcacttgattgcctttgtgtccctgcttcaccttttgaagcatagggcctaattataatgtatttaaatgttgtctccaccccaaagtgaacatgggttgcatgtaacaggcatgtttactcagcatgcatgcagcaggatcccttcacaaatattcagagctccccctattccctgttgaatatgtatatgtggccagccagatcaacgtaaatcactattcgccctcccctccctggaaacctacttttcgggtttcagcaggaagctatgcctccccgtctgtcagaatggccacttgcaggctgtaaccctttataaaaaaataaaatctcctttctaaatttataaattgtgtgatttttcagttgacagctttcagttgtcagtcaagtcattgactgggaaaagtcatttgcaatatatttatttgaaaaatgactcaactcctgaatatataagagaactttcataaatcagtaatatagagctaagccaaataaaatcgggcaaaatattcgaataggcctttgcaaaggagaatttcttatatgctggaagccataagaaaatatgcttcatagtattgctcattaggcaagtacaaattaattccacactgagataccactaaccaatcaccagtgtgtggctacttttttttttttctctgagacagggtctctctcacccaagctggagtgcaatggtgcgattggtgcaatcttgagtcactgcaacctccccctcctgagtagctgggactacaggtgcatgccaccatgcctggctaatttttatattttcagtagagatggggttttgccatgttggccagtttggtctgagagcatagctacattttaaaaagttagtacaccaaatgctgacaagaatttggtgccacttcaactgtcattgctggtgaaaaaacattctagaagactggcaatttatactaatgttaaacttgtactcaggtcgtgacccagcaattgaagtacttccatgaatctcaagtgcacaaaaagacctgtagaagaatattcatcacaagaattcaataacaccaaaattgagaagtgatctatgaaactacgtggatatatctcatgagtataatgaacatacctgcagaaaaaaggccagatacaaaagatatgtccattcactcatgtgaactttaagaacaggcaattgtaacctatgggaatagacatcagaatagtgattaactaagaggacacagggtgggaattgcctggaaaggggctctaacaggcctttctcagatgatggcaattttctataacttgagctgggtggtgattacattcatcaaaaataaacgaactgcactaaagatttgtgcactttatgtgaactgtagtttatttactgttctcattgcttgaacccgggaaacgggacgttgcagtgagccgagattgagccatggcactccagcctgggtgacagaacaagactacatctcaaaaataatagtaatagtaataatttactgttctcataaaaattagcggatggggaatggaggcaagccggtgtagaccatgacaactagtttagattttattgtaaactcattaaaagctcgttctcgttttgtgtttttaaaaaatcccactgatacagccgttttctctaccagatgagactataaccgtattatttcatcagtggaagctacagacaaagggcccttgagaggcggcatcttcacctatgggaattttttctgctccattgtgagacaaagagcatgtccgagttttcattttggccaggccgccccctagtttacgcactgtgggctaaactccagaagctggcgcccttccgggccagcggtttactccgctctctggaggctgctaggattaaaggcaaagcaaacgacaggtcttttagctacaatcgcaggagagaaaacactactgtgactcagattagaacccaggttgcggcaaccacagctgcaagtattgaccactacacgaccaaaaagcctgctgacaaccattgtacttcttatatttttttatgtaaaaacactcatactattttctctgctttattctcgaacgtctgcagattttcgtgcttttctctctttcatgcgcttctccgttactctctccccattccgctacataatttaaaaaacatctcatctctcaggacctggccactgcctctacaacaagcctcctgggaagtctcgttgtcccatcgacacctctcccttctttcgctccatttttttttttttttttttttgacggagttgctctgtcgcccaggctggagtgcagtagcgcgatcttggctcactgcaacctccgcctcccgggttcaagcgattctcctgcctcagcctctcaagtagctggaatagcaggtgcacgccaccacattcggctgatttttgtatttttagtagagacgggatttcaccatgttagccaggctggtcttgaactcttgacctcaagcgatccatccgcctcggcctcacaaagtgctgggattacaggcgtgagccaccgtgcccggccaaatttcaggccaacacctgttgacacacattgccagacacacggaatccctcactgaacaccgatgggcccacaaaacacgcggaggccacggtggctgaagatgttagcaaattcggttcgcggtgtctggggtacagcctcgagggtccattggctacctctgtgcaaggaccactctgcgcaaggaccagtcaccgctgctctcctcatctccattgagattctcccgcacacacctcccctttctttgggccgctgaggcctcttggacctccgaggtgattgccccgcccgcagcttctctccttccgggagcttcatttcttgttcctctccgtagtggctcagcggtaagcccaaggtccagcacacgaatcaggaaactgatggttcttgggtttgcaggaatccgcccagagaacagatgaaagtaacaggtaccaatatcaaaactgcagtgactcaccagaaacactacgtgcttgccactttgcttagcggtttgttgagtccaacaactgcgtgggtcccgggttagtctcctgaatgtcttttgctgctactttggtcagcgttgttgtcagtttaccttgtggtggccaagcccttaaatgcactattaggttatgcagtgtaattctgcagggcagaagggtaaagagccatagtgaagagcaaaagaacctcttgccttgaccgggaattgaacccgggtgtcccgcgtgtgaggcgagaattctaccactgaaccaccagtgcctctccccagcaacccttggagaattatcggaaagagtatccagaaagacttagaaacttccaagcggccttttcaagtgtcgactcaaagctaacaaagacatccaaaccaaatgtttttataggaaacttttactaaacaaagttataaatatcaaaatagctcatttgtcggatcaaactcttaactctgaaaaaggtctttctacctgcattacatacccctataataaaacgtcacaaattcattcatgtttcttttttctaatcctaaatcttcaattgtcaacgtcaaactgctgccttagtggttctgagaaggtaacctaactggtagcttaggtaagtaaagttctaatccagggaggaaataagaagcagaagcagaattagaattagaggaaagaggaaataaaaggacagaatcaaggtagagataatgaagaaacaaaggttggtccactgagttagtcttttgtcgctggtttttttggcaaaagagtaatgatcggtcttgtaaccataatactgttatttgtctgcttgaagatgtataaagcatttaaaggaaatgtgatataaaaagattaataatgcctgcagtcaatatttcattgttagagagaatccaatttcctaagttaatatgctttgatgtattagctatgtaaggagtagactagtttaaggaaatattgatggtcaaaatattaacatattagtcttttgatgaagttcaaatagagagatttcttttctcaattttccctggagagattaaactgaagagaaaaattcagagagcttgccccacatgttgggtctgtgagtcattatgactttttcaaagacaggagctgtgacatggaatcatgcttcttctctagctgagaagccaagctaggtccaggctgggtcataaacttgagcccaacaaggaaatcacccttcacattgacctcacagagctttgactgttctctgttctttgcccaacacccaagacacacaccagctctggccaacaaaccttaacatattatctatatcaaccagagctacatttattcccaaatctccttctaaaatacaaacctgtactttctactctcaacttctaaatttacaaaggcctcatatgcatctcagagtcacagatgctaaaactcaacacaccggtgagttccctgtcagcaatatgtaccaccctctacctcaaaacccaatgatcagactcaagcacagcatctcccaaagagtagtgcactgccctgggtgtttcaatgatcactaaaacctgtttctagccctgcctagcacacttatcctcaccaccatctatcctatttgccaagccagatctttctttggataaactctctcattttcataacacaacaatttcagttcaattcaaaaaaaatagcgtttaagtttattggatactccacaagcttactgccactttattaccacacttttccatctatcggctcttgcatccattaacataagcagacaaaaaactggactcctggccaggtgcggtggctcaagcctgtaaccccagcactttggaaggccaaggcaggcggatcacgaagtcagaagattgagaccatcctgactaacatggtgaaaccccatctctactaaaactacaaaaaaaaaaaaattagccaggcgtggtggcacccatctgtagtcccagctactcgagaggctgaagcaggagaatcgcttgaacccaggaggcagaggttgcaatgagccaagaccacacaactgcactccagcctgggtgaaaaagcaagactccacctcaaaaaaaaaaacaacaacaacaacaacaacaaaaaactggactccctacagccagtgtagtatgcaccactcacttgccacactgtatgctgagtgacccttccacagcttaaatctgcacataacttcagcctagaaccatataatgtccctttatttcttcagtacaatgattaataccatattctctgtacccttcttcactctatgctcatcattctaacagctcttgccaatactcaaatccaggagcagcaaactacttcacatgtcacaaacttttcacaggttcacaccagtggattccccagtgaaccagctgtcttaactcaggcttccataacaaaataccacagactgggtggcttaaacacgaggaatttctttctcacagtttgagaggctgagaagtccaagatcaaactgccagcggattcacctccttggtgagggctctctccctggcttgcagactgctacattctccttctgtcctcgcatggtggagagaaagagagcactttcgtctttcttctgtttcttataatgacactgatctcatcatggagatcccatggtcatgacctcatctaaacctgattacctcccaaaggccctacctccaaaataccttcacattgggggttaaggcttcaatatataatatgaagggaacacaaacatccattccattacactagcacctgcatttgcaatccagcctctgggccaggcttagcagtgtagagcccaaggcttcaattgacaggatttttatgctctcatgctctggctccttggctccagaagcttctagaaccagtagggtgatacatcctttagcaactatattgtaaaacacatggtgggtaaaagagtgccctattaagtattttggttatgcccccattagtgtgcttggctcaatatattaatagtaagtagtggttcgcatccaccctcagtaccgccctctgcagtcatcctgtcagtttccattccattctcctatccctggcttgctggttcaatactcttaagtgatttactgctggtgctcttctttttccctcagagataccttgtgatttctttgattctctccatctctacaggttaataagtctaatatttaaaaactctgtagagggatgttgggaagctgtggggagagcccttgggcttttcgcctgggtaaagtgcagattcctgagaattctgggccttggcttccagctgcactagtgccggccactcagctgttctcagcagcgtcacctggcgcaatggtgctgaagcgcactgccgagaggccagaaggcaaagcgagagtcggtggctatggcctggaacccatttaggcaaaacagagggcgcgcggggacaaagcaatagagaagggtgggcaatacaggatctgtacaccatacattagcaattgtatttattaaattgttgattacctaagcctccggagagtagtttggacgcttaccggttttctgaggattatttggggaaggggtatgcatgcaaatgtatgtacataattcgtgtgatttcggaatattgactccatgagttccagatgcagatttggaacgtttttaaaaaacattttgtttttgttgtctcgcaaatcagccagatctgcaactgtatcagagtaaagcgaagccaagctggacccttaggaaatgcgctaacatgtcatccactttcggtgtctgcctgtgaaaattcaggcgataaagagaatgaagagaaccttaaggaattgctggaaccaaagttaatattaagcaggcctgctgtgacgtcctcttcctggcagaccagtggaaattgtagcctggtcgacaatctgtatagattgatgaggtctaaaatgtagtcacaggttcaactacttttctgttttccaacctcgagtaaactcactaaatttaagggctaacaaaaaaaaaaaaacaaaacaaaacaaaaaaaacctctgtttccgcccagtttcgaaccggggacctttcgcgtgtgaggcgaacgtgataaccactacactacggaaaccacacgcggaacctgcgcggcaaaacataaccatgaaaatcttagatcagccgtttctattatagtttccaaatctaagatcgcaccactgcactccagcctagacaacagagcgagagtctcaaaaaaaagttaggagaagaaggtgccattttccctagttgcttttcttactgcggtggtgaccgcattgccttcacacctgaagtccaagtgtttgcaccctggggaatatgcagacagctgggtcactggacgccaggccgcagcgccggcctcgttctgcttttggctctaaatgcagtcgggggacgcgactggatctcaccagagactggtgggctgttacccttaccagcgactggagggccaacctcccaaagaggcctacttcatgatcgccttaaatcaggaaatttcatgaaatcccacccctctaccgccccattcccatattgtatctcctcccctgcccactctgagaggattcgccccctttctgtctcgtctggaccctttggagtcccacatagacaagacaaaaggggcattgccttttcctacaggagcgggaagagccgtcacagcggaggaaacagagactcacagcgcgcatccccacatacttgcgccctgccgagttccagcaaacccaacaaagcactctgaagcttctctggaaaaggaaggagtgtgaggtttctgatacggcaagaggagccaaagagaggggacccaggccttcccctagctcgagagaacaaacccagaagaagggcagatccgaaggaaaagcgcaaaggcggcccaaccccacgacctgagcgagccaagggtcgcgggttaaattgcgtttatcagaacaattgtttgctcactgtcccaaagccctcctagggacaaagaaaacactggcatggcaccagtcgcagaagggggcagcattgacacccaggaacaggcgtggaaaagcaggaaaagcagggatcatctctctcctaccccgtatatggctgcagacatagcagtggttcttttctccaggacccagtgagtgtgcaccaggagagaacattatgcacgttattcatggtggcaccacccaggctgaaagtgagcctgtgctgcttgggctttcaggaaggacgggcccaactctccctccctatacagagctgcagtgccctggcaatggaggacagaccatggagttgcctgccctggactcggggaagaggctttgccctaaaccccattttagtggtagctgtcagagtgccatatccacagacttcagctgcaccacagccaggaaccaaaggacaaagtctttataaaatgaaggttgtgagctctgtgacagggcatgatagggaagcggatcacattcttgcctactcaggaggaggagctagtgcacctctgccccttcccctgagacctcagcacaccccgacatgatctctttcccaccatcctgtcagggcaggtttttccactggacaccagcctacgtaacagccctgactcttaagcaccatctactggactgcatcctaaactggaccactgaattcaaaaaccctgctaccaaagggcttagtgctagtccatgagataagtttcctgagaattccgtaccctcagcccccaacaagggttagtgtgttagcttttacttccaatacatcaccacaacaagcagcatctgagaaagctactgctcagaagctatccacaaccaagaaacccatacaaagctagggctccctgaaagcacccagaaatgaagccaaacaatcatacacaacatacaccacagtcataccatcaagggaaaaaaagaataaaaacattaaaaatcctcatccaaacaataccaaattcaaaactaagaagcaacagcttcctcggatgagaaagaatcagtgcaataactccagtgtacccagagtatttacacacttccaaaggatcacactagtttctagcaatggatcctagccagactgaaatgtcggaaatgacagataagaattccaaatacggattgcaagggaactcaatgagatccaagaaaaagttgaagtccaatgcaaagaaatcagaaaaacaatacagaatatgaaagacaagaaaactatattaagaaaaatacaaatagaacttctataattgaaaaattcactaaaggaatttcaaaatacattgaaagctttaataatagactagacaagcagaagaatgaatttcagagcttgaaggttggtctttcaaattcacctagtcagacaaaagtaaagaaaaatgaatttttaaaaatgaacaaagcttttgagaattatggggttatgtaaagcgatcaaacctatgacttattggcattcctgagagagaagaagaaaagtaagcaacctggaaaacatatttgaaggaataattcaggaaagaattttcctaacctttcaagagagattgatattcagatacaagaaattcggacaacttctgcaagatactatacaagataaccagtgaaaagcatacagtcatcagacttcccaagataaatgtgaaagaaaaaatcttaaaggcagctgaagaaaagggccagattatctataaaggaaatcccatcagactaacagcaaacttttcaaaggaaatcttacaagtcagaagaaactggggcctatttttagccacctaaaagaaaaaaaaaactgcctgtcaaagtttcatactctgccaatttaagcttcataaatgaaggagaaatagtttttcccagacagagaaatgctaagggaattcattaacaccagatagtctctataataaatgttcaaaggagttctaaatatggatggtacttgctaccataaaagcacatgtaattacaaagctcgtacaccttataaagcaatatataattgggtctacaaagcaactagcttaacactatgacagaaataacacctcacacatgaatattaaccttgaatgtaaatggcctgaaagttccacttaacgggcatagagtagtccaggtgtggtggctcacacttgtaatccctgcagtttgggaggccaaggtgggtggatcacttgaggtcaggagttcgaaaccagcctggccaacatggtgaaacttcatctccactaaaatacaaaaattagctgggcgtggtggtgggcgcctgtaatgccagctactcgggaagctgaggcaggagaatcacttgaacccaggaagcagaggctgcagtgagccaagatcgcaccactgaactcagcctgggactccatcaaaaaaaaaaaaaaaaggcatagggtggcaaattgggaaaaaaaaaaatcaaactttccatggcctttaagagagacctatcttacatgttatagcccccaggggctcaaagtaaagtgatagagatctgttatgcaaatggaaaacaagaaaggtcaggagttgctattcttgtatcaagtaaaacagactaaaccaacaagagttaaaaaaagaaaaaagacaaagaagggcattacataatcagaaagcattcaattcaacaagaagatttaactatcctaaatatatatgcacctaacattgaagcacccaaatttataaaacaaatacaactacacctaagcaaagaaatagacagccatgctatactagtggaggacttcaacatcccactgacagcactagacagatcactgaggcagaaacctaacaaggaaactttggacttcaattggactcttgaccaaatgaacctaatagatgtctatagaatactctatccaacaaccacagaatatacattgttctcatctgtgcacagaacattctctaagattgaccacatactcagtcataaagcaagtctcaataaattttttaaaaaatgaaattatatcaagtatcttctcagacaacagtagaataaaagcagaaatcaatgccaagaggaactctcaaaaccacacaaatacatggaaactaaacaacagaatcatttttgggtaaacaataaaattaaggcagaaataaaaaaaaattgaaacaaatgaaagtagagacacaatgtgccaaaaactctggaatatagaaaagcagtgttaagaggaaagtttatagcactcaatacctaccttgaaaagatagaaagatctcaaattaacaacataataccacacctaaagaactaggaaaagaagaagaaacaaaacccaaagctaggagaaggaaagaaataactaagatcagagcagaactaaatgaaacagagataaaaaaaaaaatacaaaggatcaatgaaatgaaaagttggttatttgaatgattgatagaccactagctagattaaccaggaaaaaaagatccaaataagcacaatcagaaattacaaaggtgacattacaactcatatcacagaaatacaaaagatcctcagagactactatgagcatctctacatgcacaaactagaaaaacctagaagaaatagttaaattcctggaagcacacagcttcttaagattgaaccaggaagaaattgaaatcctgaacagaccaataatgagttatgtaattgaatcagtaataaaaattctactaatctgaaagagccctggaccagagagaattttacagctgaattccaccagacgtgcaaagaagagctggtaccaatcttactaaaactattccaaaaaattggggatgagggattcctaactcattctatgaaaccagtatcatcctgataccaaaatctggcagggacacaataaaaaaagaaaactacaggccaatatccctgatgaacacagatgcaaaaactctcaacaaaatactagcaaactgaatccagcagcacatcaaaaagataattcatcatgatcatgtgggctttattcctaggatgcaaggatggttcaacagacgcaaaaaaaaaaatgctattcactgcataaacagaattaaaaacaaaaaccatactattatcccaatagatgcagaaaaagcattcaataaaatgttacatccgttgcatgatacacaccttcaacaaaccaggcatcaaaggaacataactcaaaataataagagccatctatgacaaacccatagccaatatcatactgaataggcaaaagttggaagcattccccctaataactggaacaagacaaggatgtccactctcaccactcctattcaacacagtactggaaatcctggccagagtaatcagtcaggagaaataaaagcaatccaaataggaaaaagggaagtcaaattatctctgttcaccaaagacatgatcctccatctagaaacctctaaagattcctccaaaatactcctagacttgaaaaacaagttcagtaaagtttcgggttacaacatgagcatacaaaaatcagtcgcatttctatacactaaaaatgctcaagctgacagccaagtcaagaacttaatcccatttaaaatagccacacacacacacacacacacacacacacacacacaaataaacaaaacacctaggaatatatttaaccaaggaggtgaaagatctctactgggagaactacaaaacactgatgaaagaaataatagacaacacaaacaaatgggaaaacattccatgcttgtggactggaagaatcaatattgttaaaatgaccattctatccaaagcaatctaaagattcaacgcaattcctatcaagttaccaatgtcattttttacagaatttaaaaaaaaaattataaaattcttatggggctggacattgtggctcatacctgtaatcccagcactttgggaggctgaggcaggaggatcacttgaggtcaggagttcaagggcagcctggccaatacggtgaaaccccatctctaccaaaacacacaaaagttagcaggcgtggtagcacacacctatagtcccagctaattcaagaggctgaggtgggagaatcacttgaacccagaggcagaggttgaagtgagccgagatcatgccactacactctagcctgggtgacagagtgagaccctgtctcaaaaaaaaaaaaaaaaaaatccccatggaaccaaaaaacggcccaaatagtcaagcaatccaaagcaaaaagaacaaatccagaggcatcacattacctaacttcaaactatactacaaggctatagcaacaaaaacagcaaggtaccgacacaaaaatagacacatgaatcaatggataagaatagagaacccagaaataaagtcacacacctacaaccaactgatctttaacaaagttgacaaaaataaacaatgaggaaaatgataccctatttaataaatggtgctgggaaaactggctagccaaatgcagaagaatgaaactggacccctacctcccaccatatacaaaaattaattcagatggtttacagacttaaatataggacgtcaaactataaaaatgctagaagaaaacctaggaaaacctcttcttgacattggcctatgactaagacctcaaaagcaaatgcaacaaaaacgaaaattgacaaatgggacttaaacttaaaaagcttctgcacagcaaaagaaataatcaacagagtaaacagacaacctacagaatgggagaaaatatttgaaaactatgcacctgacaaaggactaatatccagactctataaggaacttaaatcaacaagacaaaaccaaataaccctatttaaaaaatgggcaaaggacatggctagacacttatcaaaagaacacatacaagcggccaacaaacatatgaaaaaatgcacatcactaatcatcagagaaatgcaaattaaaactacagtgagatatcatctcacagtagtcagaatggctatattccaggctcgaggcaagcgtgctcttcacgagttctgtcattctcttgagtgaagctcacctggtatggtaagttgtcctcattttaaaacattcagattttattctgcaatcctttcacatgtgacagtttttctgttcttcctaagcatgtaatggaagtcaaggaattctacatcctcactatctattaatatttcttaccttcccacagcagtgaaattcccattctagtcttctgaaacagagatagctaataaagaaaactcatttctcctttaagcttttccacacatttcagaccattctggttttattcttttctacacaaattttactctttataggtgttcaataaataaatataaacactaattttaaaaataatttattaatttgatctcttcatttaaagataatatccaatgcctccaagttcccacccaagaattctgttggatagggctggaaaagttctggagaacattcttccagactctctaggcatcatgtcacaggatgtcctcaccacagccagaagagtgactctgagtatatgaatgaggggctacagtggactgtgcagtacctagggagggagagacagggctgcaatgaagtctggagggatttaggagattcattgattgtaccaaacaaaaacttaatttcttctctcctattccgtacccaggtgaaagtgggaaagacaggaagagagacaccaagctttctagttgacagctagtgactctctgattatctgcaaagattgggaaaggaacttaaacatgacatgtagattttccagagatatttactcctggagccaggagtctgcgaacatgtaggtgggatcttttaagaagcagccttatctagattgggaataagctattatagttttaggctgtgtggatctggtcaacttttgtgctgcctacttctctttgcttctacaactgggcatcgctgcagaaaggaagaaatatggaagtgacttcagctttgattttttccttctggaagcctgaaaactccagtttgcttccctgagcccttttcctgttgcacaactagggtgtggactacaggtcctacccatggaagatggaggtagatacttcacagggaataaaaacaacccagacaagtcatacctttaggtaacagatactttcaaagatgtactttcctgcacccattaaagttttagtctcagctaatctgaaaacctgcggtcctcctgcactgggatagcagtgcaatatggctcaggctcaggttttgctgggcacaccagagtaggccacacactctcatgtgaagtggcttcaggtatggatcagggtctttcccactaattggcttcagttatgatgttgtaggtcatcattcttctggctttaatacgagagaagaagggatggggaagaactggtctccaagtgagagcatccagggtgaagagtgtggaaataagggtcattagcacaagagaagagccaggtgatatcaaaggcatgtagtaatggcataaaggtggaacgttgctctcattctgctgaagtgggcaccatggaaaccttggtgctaccactcgccagtcaggccacaagcccaagaacagcaccaggcagtataaggacatataagaatgacatcacttcagatagtcctgagaattagacctatccctgcttggggcaaaccactcagtgggagcaatagtacccttctgcttccctatctgggctaattgtaaggaacaagtgaaatcatgcacaccaatgtgctttaaaccggtaaaactctgccccaagaagctatgtgcccttttgagactccctagacgtggacagaaacataaaatttctgcctttctaccttttccttggtcaccattgctaagcacatgctgcagcctctccctcaggcggtcattgagactgatggactcctccaggcgctggcgcaggttctgtatctcagcaagattcttttccagcaggtcggcccctactgcaaacaccaagacataggagaggtaggaggtagggaagcctgatcatccctgggcagctgtggggcctgcgtggcatctctctgcaagatccctacctatctctatccttctgtcagcttcttcctctctcctgggcattcaggaagcaccaggcaactttacttaaaagtcctgggctttcaatcacagggtggccccctgtaaggaaacaccacaggcctcctcccagacagagaccaccaagtacatctaagggagatggacacagggtgagaaactgctaaaggcctctaggcagaactggcctagtaatgggaaaggctgtctacctccttggtatggaaaacaatccagagaatctccctctctacctcatccctctccccgatgatgatcccgactcaacagcctttgagatttcactcactcacagacagaaagaccaaggtaagtgcatatgaaattaaaccaggctgtgaataatgagtgatagtgaatgttctcctttaaccagttttggcaaagaggaacatggaagagcttgggaaggtatcaggatctgaagtgggggaacaggagagaagggaacaatctccaaggaaggaaaaagatgcacagagagaggaggctgagaataggcttcacccactgggagattttgcgtagggtcaggcttttctctgagaatttaaaatgtcttattgttacactacctgggacacagaaatggagctgcttcaagccattcctctaaatagctgcactcctagctgccgggtgccaggatgtttggttccaaatccaaaagcaatatttatgggggcaggattggcacgtggttgtatgcacagtgtgtgtgaaagatgtgtgtgaaagagtggaaagagtgtgtagggctgggtgactctgtagaaatagtttcccatccgacagtagctcctgacctaaggaagaccttccccatggaaatctgagcttagcattccaggacagtcttaatctaggcctaagaaggttgtagcacagagagaaggcaacatttaagtgtgaggtaacttatcctccttgtagagcacctcagaatgtccctgacttctcctactctcctgcccagagtgagttcctaggtagggtggctaggagaaggcactttcaaagaacaagcactgagctggttctcactgtctggctgatctacatattgtcctgtcattttttatgaaccaggttctaacagaggaaccaaaaaatcctctggccaggaaaggaatgtgtcattcctaccaatgggctcgatttcactaagtgctcctttgtgttttaccagaggtttcggagttgggttggtacaaagaggagaaggaggctaggtctccagatgcattcattttttgaggcctcatctcttcccatgggccactgctaccgtgttctagtgtcctgctctgctgggccagtgccgctcgaaggatggaagggctgggcagacctggttccttggttgctgggcaaagcagctgaatcagcagaaatggcagggctggcatctgtccagaaaggaatgtgagtgagaaaccaacagggaagtcataaaagagtattttaaaggtaattatagtgagttgaatagtgtcctccaaaaattcattcagttcacttggaacttcagaatgtgatcttatttgtaaatggggtttttgtagatataataagttaagatgagatgatactgaattgggggtatgtcttaaatccaacatgactgatgtccttatgagaggagaggagacacagagataaagagacacacagagaaggagaccatgtaacaagagaggcagagattggggtgatgtgtctacaacccagaaaccaccagaaactaggaagaggcaaggaaggatccttccctggagtcttcagagggagcatggccctgctgactccctgattttagacgtcttcatctccagaactgtgagagaatacatttctgttttaagacgcccggtttgtgtttttttgttttggaagcccttgaaagctaataaagcaatccacggaatgaagactaaggcagatgtcagcagactcatttcccaaggacttcccatttcaccctaaagtaactggcatttctcagcctatgacataagcagtagtgttagttgtaatatctgagcatcacagcgcacatacaggaaaaatatggggcccctctcctagctccctttatgattcccaatgctggaatgatcctggggaggtacttcagaaatgtttctcctaatagcaggactcacagccaatcctaggagttcagacagtgaggggtgaagcattttgttggtctgtaaacaggtgactatttattcaacattctatgcccttgctagaaacacaccagctactccttcctgggattgttctacactgaggctgttggaggaggaggagaaaatggcctccacttctggacaatgtgcagagaacctagagagtgttgcttccactcctggtggttctctctctggcctcggctgactctggacctgcagtgaagctgagggggtgtctgtctaaggcaagtggtgatttggattccacctagaatggcttttgacactgcaaaaataattcttatgtacagctcacattgtctggctcctgtccatagaatagctagtgtactcttgcatagaggattgtagaatcacaaaatacatggcatcttacagctcaatgatgccatgagaacatggccagatcctctgggcccttcattactgtctccctttgagagaaaaaccaagctggggtggcagggccataattcagagaaaagttttagagtctttccctttcgaggattattatcaagggctaaagaatagacaagtttctcctctgagcaggtgggagtgaggtttctgtttgccctcaacaacatcacgttcttttaggaactgtatatttaaatcagtatccagtaggtctctccttctccaatttataaaatatcagatactaattagaatcactgtgagataaagagtaacgacaactatgttaagtctttaataaatgcctgacttaaagtaggaactcaatcaaaatgtgattaccaccccctttcaaacctcctttatctcagaaaatcagtttactctcaaccatggccataggaagctctaagttttatcagtaacagtgatcagtgttttaacgttccctggccataccacaaggggaacatgccctacactgcagatggaaagcaacagagactagacttttgtgaaggaaatttggcctcacaatgtagctgtcatgccagtgcactacaggttgactgttctagaaattttggttcaaaaaccaaagaggaagtggtgataaacagttgcccctgtgaaaggacagtgacttcaagtgggaaagagaagggcttcgatctccctcaggaaagacagttgtggcaaaaagtaaagctggtgctctccagaagcatcattccagaggccacacctcactgcaggcagtggcagggattgcaggtaagggaagcatgggcttgcccttctgccatctcttggggcagtgctgaggttgaaacaagtgcctctgggcaactgaatcaaggatgcacataaaagtcccattggccccttggaataggtgatgtacatatcaagggcagctcatctatttacaaattcttagatagaagtgtaatatgtgtaaggtcttgtcccatcttcagaggccagaactctgctgggtgcacagagcagaaaaagtggaatgagaaaaaccctggctccagaagcctagcaaaagaggtgctgagaaggagtgagcaccctttgtgtgcagcccctgacttctcaggctgcagagtgaaatgctcacaacctgagctttgagtcaggtagactcaaagtgtatgttaccccaagctgctttgtcttcagtaagttccttaactttgctgagcctcagtgtcctccactataaaagcagaacaccactacctatttgaggggatcactgtgtcaattaaatgaggaaatatatgtatagtggtcaatattgtgagcataataggtgctcaatcaatgagaagttcctgtctttccttggctgctataatcttagaggaaacattttgccgctttgctcctcattgtgaaatgagaaacaggaatagtaccagatcaaaacccattatgggccgggcatggtggctcatgcctgtaagcccagcactttgggaggctgaggcagttggatcacctgaggtcaggagtttgagaccagcctggccaacacggtcaaaccccatctctactaaaaatataaaaattagcctggcgtggtggcaagcacctgtaatcccagctacttgggaggctgaggtaggagaatcacttgaacccgggaggcagaggttgcagtaagctgagattgtgccactgcactctagtctgggcgacaacagcaaaactccgtctcaaaaacaacaacaacaactaaaaaccattatggctcactcattacttaaaattgccaatttagaaaaaaacaccagatacagccagggactaaaaataatttcttggtattgtccacattaggatatgattcatactggcctaaaacttcaaacacttttctcaagaggaaaattaaagagaaaactgagcaggagaaaaatgaaagtctggtttaaaacttaatctcttcccgtctctatcaaggctatcccaaggaccctctcagggaaattctcaggagggacacgctggttggtgatggactcagcttgaacctcacagcatggccccattcactgatagtttagagggtgttacagcaaacttattaggatgatggatgggatctgtaaatgcataaatgataaagatgatttagtgatgaacaaaaaataggaactgtggctgtttaccccagggattccaggattaggtgcacaatgttagcaacactcatgtccctagtttgaaagatgacataattgtgtgcagtgaagaggaactatttgccccctttctccccttcccaacccatgccccccaagaccaacaccatgtatgtgccagaggggatctagtgactgatgacatgtgagactgggaatggagaaaagctacctgaaaaccttggggcttatgctcagcactgagtcctggagctgtgcccgaccagctacatcacagtggatctacagggcccggctgcaaagatgccacctcttggcctagacaatgcatgagccccaaaaactggagccatgtggctactcactgactacagtcactgaaggatgcacttcctccttgtcaagctgtggagacgtgctgctcagggagtgatgtgggctagaccgggtgtggttgctgcaccagatctggggctgagtctgggaccgggcatcccacttggtctctaggacttctgtcactttactcatattatgcatcttcctcaagatactagtggggtaagaaagaagaaaaaataaaggtcacctaatgccacagctgtactaatctggaggctcacaggagatgtaaaggggaggtcaagaggatcattccttcagaggagaagccaaacaaatcatttctgtttcaggatagagtatggagggaaggcggggacagagagagcaacagttgtctggtgcattggctacaaacatcctgaggaaaaacgaagccataatgggccccttaaataacactcatgattccttcacaaaacagccagagacccataagagttcaactccaggtatgggtatggcggtacatgcctgtaatcccagcaatttgggaggccaaggcaggagaattgcttgagtccaggaattcaagaccaaactgagaaacatagtgagaccctctgtctacaaaaaataaaaataaaaaatgagctgggtgtggtggtgtgcacctgtagtcccaactatttaggaggctgaggaggatcacttgagcccaggaggtcaaggatgcagtgagcagtgatcgtgccactgcattccagcctgggcaacagagcaagacctcatctcaaaaataaaattttaaaaatgttaaaaaaaaaagaattcaactcattctgtgaacataatttttaaaatagtatttgctataggccatttaaaacagattccccaggcaatgtagcctcactggtgtcttgcagtttctagatctccttccctaagtatagagacacagtataaacttttgtttgcaaggaaaatttgtagctgttttacatcttccagcactccttgggtcacccttgaagaaatcagatataatcttactctggtctttaaataagggaaaccagaggtgatccctggaggttcagaagactcctaagacccagataggttagagcagctctatgttactaaattggtgaattaattggtgaaaataaaagaataatatattttttaaaaaattttaaaaatgagactgccttatccctaaggatacataatggtttaatggataaataagctatttgttttttactggccatgtatgctcctgtttctttgagcttctggctcttgcttctggatccttcaccagattacatcttcgacagcccctgaaaatttggagttacctgagagtcgaagacacctgtcctacttgattcttcttacttgtacagtcatctgagaacaaaattcaaaaaggccagtcatgctttaagcaggtctcatttcccagactgcaaacaaacatggaggtctatctgggagcagagacttgactacctgatgcttgccttgattccaggatactctgaattttctcagatcttgggttgagtctttagagagcttgcctggcaggctttcctgagcccaccatgaaggtcatcatctccacttgctttgccctgagtcacagcaaaaagctaaaaatgtctttattcccacatatcatggaacacatatccactccagccaaagcctccaagtcctggcacaaggccagcacccaaacccatggctgtgtgttccaccatagctttcatgcagaacttcctcccttctccaaggagatgatagacatccgtgtcccacctaccatcaggagacagcacagtgaactcaagccttctgctactatgggcccttgggttctcaagggggaatttcatgtaaaatgctcctgaaacagctaattatctcaccaccgtgtactagtacacacagtgcctgaaccatgccaaagtcagcatgattctttatcatttttttgaagtgcgccgattaatgttacttatttaatccctagaacaatcatgcaacattcaagggctggaattatttgacttaattttttaggtagagaaacagaaatcaaaataaatattaacctgtccagagctggtaaggaacacatataagctagaggtagggtttttggattcccagttcagggcccttcacaaaaaccagctgcccctgctccttctgtctttctgccaattagtttcagatgaataccatcatccctggggatgcctcctgccctaacagtcatattccatgagggatggaggtgctggtgatcatcatggcatcctcaacccttcttcttggagctcctctccagccagtcctgactctgtcatggtcataaggtggtgattacaaagcaggacaccaggttgaaaagtgacatgtgaatgggggtgggatcctgtgaacttaggaccttgggagagactgaaaatcttcctaagctctgcggccaacttacctgtgctgaattttctggcaaggctctctgccagctggcttcctttggccagctgcttgcagtagtgctgctccatatagtggtcaatgttattgctctggagtagctcctcaaaggtctttagtgtgttcttgacatgctggatgagaagaacagaggccactctcccaagcttcatcttctgccgtaggtgggttaactcttgagcctgatcctgaatcaaggaatgatacttcctaaagtagaaaaaaagaagtaaaggtagataggaataactgataggttatagcaatttaggagaaggaacttgagagtatcaccaaaggaggccacacactgaattctagcatatgtttagtgtcctgaatatggtaaaaggaatgaaggaaatgaaaacaatctttatgtgaaagatcccttctaagattgtcattttccctgccacttgctaaagaagaaaaatcacttgatcatattaatagatgaagaaaaagcatttgacaaaattcaacactcattcatcataaaaactctcaacaaagtgggaatagaggagaccttcctcaacttgataaagaacatctataaaaactctacactaatgtcatactagaaactagaagctttctcactaacatcaacaataaggcaagaatttccccgcttaccacttcttttcaccatcatactggaaatcctagctaatgcagtaagataagcaaaggaaataaacggtatacagattagaaaagatgaactaaaactgtctttgttcacacatgatgcagttattgtattatagaaaatctccaacatggtgaaaccctgtctttacaaaaaatacaaaaattagccgggcgtggtggcatgcgcttgtaatccagctacttgggaggctgaggaaggagaattgcttgaatccgggaagcaaaggttgcagtgagatgacatcgtgccactctgcactccaccctgagtgacaaagtgagacactgactcaaaaaaaaaaaaaaaaaaaaaaaaaaggccgggcgcggtggctcatgcccgtaactccagcacttagggaggtcgaggtgggcggatcatgaggtcaggagatcgagaccatcctggctaacacagcgaaaccccgtctctactaaaaaaacaaaatagtagccaggctactcaggaggctgaggcaggagaatggcttgaacccaggaggcggagcttgcagtgagccgagattgagccactacactccaacctgggcgacacagtgagactccatctcaaaaacaaaaagaaaagaaaagaaaatctgaaagaattgacaacaaaaatctcctggaactagtaagtgattatgtcaaggtaaaatctaacaaaacatgtacaagatctgtatgaggaaaactgcaaaactctgttgagagagatcaaagaagcactaaatacacagagagatattctgtgttcatggacaggaagactaaatattgtcaagatgtcagttcttcccaacttgatctaaagattcaatgcaataccaatcaaaatctcagcaaataaattttgtgaatatcaactaacagatgctaaggtgtacatagagaggcaaaagacccagaatggccaacacaatattgaaaaggaacagagggctgatatgacctgacttcaagacttactgtaaagctacagtaatcaggacagtataagatttgtgaaagaatagacaaataagtcagcggaacagaatagagattccagaagactccaaaatatagcagattgatctttgacaaggggacaagggcaatacaatggagaaaagatagtattttcaaaaaatggtgctggaacagcgggacatccacatgcaaaaaaagtgaatctagacacagacttcacattcttcatgaaaacttactcaaaatggatcataggcctaaatgtaaaacataaaatgataaaaaaaaaaaaaccctaaaagataacaacagctgaaaatctagatgaccttgggtttggtgatgactttttatttattttatttattgatctaaagattcaatgcaataccaattttaatttagagacagagtctctaaataaattaattattttatttatttgttggagggcatgatcatggctcactgaagcattccttgggcgtgatcatggtgtgattatggctcactgcagccaaactcttgggctcaagtgatcctcttgcctcagccttccaaagtgctgggattacaggtgtgagccaccgagcccagctatatgattacttttcagatataacacaaaaggcatgatccacaaaagaaataattgataatctggacttcattaaaattaaaaacttctgctctgcaaaaggcacatcaagagaatgagaagacaacacactgggagaaaatatttgcaaaagacatatctggtaaaggactattaagccaaatacacaaagaactcttaaactcaacaataagaaaatgaaccacacaataaaaaatgggcaaaaaaccctgaacagacacctcaccaaagatgatggcaaataagaatatgaaaagatgctcaacatcatatgtcattagggaattgcaaattaaaacaacaagataccactctacacctattagaatggcaaaatccagaacactgataacaccaaatgctggtaaggatgtggaacaacagatattctcattccttgccggtgggaatgcaaaatagtacagccactttggaagacagtttggcattttcttgtgaaactaaacatactcttaccaaatgacctaaccatctgctcctcagtattttcccaagcgagctgaaaacttaagttcacacaaaaacctgcacatgatgtttatagcagctctattcataactgcaaaaacttggaagcaaccaagatgtccttcagtaggtgaatggataaattttggtacatgcagtcaatggaatattatttggtactaaaaagaaatgagttatgaagccatgaaaagacatgaaagaaccttaagtgtgtaagtgaaagaagccaacctaaaaaagctacatactgtatgactctgactatatgacactatggaataggtaaaacagtggagacagtaaaaagatcagtggttgccaggtgttaggagggaaaggagaatgaataggcagagcacagagaatttttagggcagggaatagtcattctttattacaatggtggatacatgccattatacatttatacttgtgtcaaaacctatagaatatacaccaccaagaatgaaccccactgtaaactgtggactttgggtgatgatgagtcaatgtaggttcatcagttgtaccaaatgttatcactcgggggcaagatgttgatagtgagggaggctgtgtccgtgcaggggtagggggcatatgggaactctctgttactttccactcaattttgctgtgaacttaaagctgctcttaaaaagtccattaaaaaaaagaatgatcacagaagtataatttttaaaaatatatttgatgaagtgggtgtagtgtagcctttgtgaatcgagagcacaggattccaatgttatctctgccagaggctattatgcaactttgatcaaatgactatctcttagggcctaagtgttctcagttctaaaatgaggtaatgagactaactgactctagagttttttgggtgttttgttttgttttgttttgttttgttttgttttgttttgtctgagatggaatcttgctctgtcatccaggctgaagtgcagtggcgctatcttggctcactgcaatctccacctcccgggttcaagcaattctcctgcctcagcctcccaagtagctgggattacaggtgcccaccaccatgcccagctaatttttgtatttttagtagagacggggtttcaccatgttggccaggctgtctccaattcctgacctcaagtgatctgcccacctcagcctcccaaagtgctgagattacaggcgtgagccactgcgcctggcctagcgttattttagccctaactaacattattctctgggtcagtgaaatttaagtggaatatattgggcagtgacctaatggagcatgaagcaggatttgaatcacttccaaagctgtgcaccaaccacttaggcaaattagtgatttcagtaacttagtatttcagtaactggcgctcacaggcaaatgcgtaatggattaaccccatattatttaaatgcttccaaaaagctataggaaaatggccatgaaaaacaaactgacaaatttagccaacaggccactatttgacaattctgcaagcttatttttaaaattcagcttatcaaaactgccattccagaagccagggacctgagtttccatagaggatggagtagaatggaggggcctctgtataaatctacctcctcgggaactgggacagttcagcattcaccagagtaacatatgaagaaacaggagattcctacatgctcctggggatccagaagagagaccactcacatgactggaagatttccagctcaggtaaccacaaaggccatatatttggtgaatacatgcaatgttagttagaataaaaccaaatttctctgaataatataaagtcattactaataaaacttttatagatttttctctgaagaaatttccaggaaggtgttaagagaaaaccctacaattaaggtatggaggctggctgcaggccctgaaagctactctgacgagcaatgacttaatgctgatagtgggaagtctcttgcccactgcaggatacagagaattcttcctcaacccgaggcttctgctcattcactcccttctcagcaggtcccttcttctctgagggctgatgcatcccagccttctgctgggacattttctcatgaagagctctcttacagccgtctttgaaaggaaggacagagaagaaagatgtctatgtcttcacaatggccaggcttttctccaaaactacctaaagcaattgaaacaaaattatggcttacagaggttagattattagtggagatcctgtaggacgatagaatctcaagagcagagcctaccaggaagtagagtgaagcctacaacttcctcagccatgaggacccaacaatccactgggtaaaagaaagatgcagcaagtgctggggtggggtcggggtgggtgctgttatgagaaggaaggggaggtcccacaggtgtttagaagaaaaaacaggcaataaatgaatgaaaacaaatggggtttaaactaagctaagggatgagtatttttgtttcttatagctgagataaggttcttatgaagttcccagggaatgtcccttcagaggtcaggaagcattttgcttccacaagttttgagagtcatgaaggcaggaacacattttcagatgccagagctcaaatcccatgtcactgggacatcaacaatagtgctatggggaagactcagggtgccagctcttgagtcacaatcacagaattagaatgtggaagtagctacagaacccaaggaagccctgccttctgatagccacactcaatgcaaggctgcgtatttcaccctggaggtctctataacaggggaggccaccccctcaatagccagcttttttacccttttgcttatgttgtcaaccaatttctaaccacagcaaaataacctaagtatacctctccttgaaaacatcaaaacactttctcagcagcttttactttcttgaagacaatttcagtaaaaacaattcttgtggcttttcctaaatgattttttttttaacttctagtgattcttactcttcgtttttaggaactctccaggttttcacttcctacattctttcaagagtatagtgactaaaactggagaataatcatttaagtctgactaataaatttagcctcatgttgtattaccttttaatacataataaataatatatcccaatgcgatacttgcttcctttcccttgcagtagcaacgtgtaggggtttcatttaatatgaggtcgattttaaccttccaaactcccattccacccacctttgcttgcactcatgggaaggctcagtctatatctggtttgcccacattcctaggctatagacctctaggactcccaatttgagaggcgccatttttttggagggtagtgaattttgatttctgtctcctttgcatccttcccaatgaaaactgctttcagccactctctgctagcctctcaccagcacagagctgaattcacaaatgccttgaggggaaaacctttaccaagtgttcagttcacatctcaattcattctagaatcttggcttttcaagtcaaaatacctggacagctccacatgtctacccactccccacccccatgaggttacttaaagtgctgctgttttctctggtttttaaccactgccctctccccagcttctcagcctcttgtcccttgccaagaactagcaaataccctgagggggaaaaattgtttcattccaatgatcttctttctctctctctctctccacccgctttctgtagctggccctgtgggtcctagcttttcaaagacttcaaacagaattcctttaaaccagattttatctacttcttttcgaagggagtgctggtttgccacaaaactccatcgtaactgaaagaggaaatcttctacaaattccaggtaaatcaaattttcctaccttgatttctgaagaaaacaaaaaaaaagagaagaggccattggtaggtatatacttgcatttttcttgtaatacttgcgtaagtctgaatgggtattaaaggctcttgctagaatcatgtgccaaagattgtctaccatgacctaaacaatcaggcctgtccaaggtccaagaatttgatcaggttggatccagtcctctggtgcactaacagagatcctgttggaggatagaatcctgctgtaggattctacgtctgtactttgagtagacacttcaagtaaccagtttttcagacacctggccactaatatggggagaagaggtcaaaaaaaccattgaatatttctaatttattttagggaatgttaaaatttctcactggtacagttagaaatgaaaacaaagacataataataatagtaataataataataactgtttcaagagcattattatgtgactggcattgtttctaagtgctttactgtgtagtaacctatttagtccacataacgaccctacaagatagtgttgatttttttgtttggtggttgttgttgttgttgttgttgttgttgttgtttgagatggagtctctctctgtcatccaggctggagtgcagtggtgtgatctcagctcactgcaacctctgcctcccgggttcaagcgattctcctgcctcagcctcctgaacagctggatcacaggccccacaaccatgcccagctaattattgcatttttagtagaggcagggtggtttcaccatgtcagtcaggctggtctcaaactcccgatctcaggtgatccacctaccttggcctcccaaagtgctggaattccaggctgagccaccccgcgcagccgatagtgttgattattacaaccccttgttgcagatgagaacattgcactgaaaggctgagcttacctttccaaggtcccatcatctctatgagagtgagagccaggactcatccagacccttgctctgagccattaggcttggtggtaactaagaagatctcactaagatgcgcattccctccttcttgctcaatctccaagatttcgaggacaaaatggaaattaaaagtaaggcctacaagatggctattattttaaaaagaaggaaagaaaattatcagtgttggtgatgatgtggaaaaattgaaacccctgtgcactgttgtttggaatgtattaggttggtgcaaaagtaactgcggtttttgtcattacttttaatggcaaaaatcgcaattacttttgcaccaacctaataaaatggtacagccactgtggaaacccatatggtggttcctcaaaatattaaaaataattatcacatgatccaacaaatttacttctggctatatactcaaaagaactgaaagcaaggattcaaagagatatttgtgcacctacatcaatagcagtattacaatagctaaagaagggaaacaacccaagtgtccaacaacaggtaaatgaataaacaaaatgtggcaaatacatgcaatggaatattattcagccttaaaaaagaaaagaaattctgacacatgctacaacatagatgaacatgaggatattatgcaaaatgaaataaaccagtcacaaaaggaaaaaatactatataattctgcttatatgaagtatctagagtagtcaaattcatagagacaggaaataatggtggttgtgccaggggctagggagggaagaatgggaaattaatgggtatagcgtttaggaactttagtctaagaaagtagaatattggatgccagaaattcagttttctttctgttccaagatccctttagctagagcgacatattgaagtcagagttcctaagggaaaatcattgtgcatggagatcatccttgtggatcaaatgtgaatcaatagtagatcaaaagatattccacttttgcagatattgacatttgttggacccgtaagattttatctagtattagatagataagatgtgaaccacttctcaacactgcagactcaaatactaggaaatactaagaacctcaggacaaacaaatagccagtccaaaaagactcacagactagataagctgtcatctaccacctaacagataatgtatccctgttaaccactatccccagatgttcatttcataaaatcaaaaacagaattccatgtggatcatggaaaaaaatggttgacaatgtacaaatgagagagagaaaaaatacttgtctaagaattacatttagtgtctaaaagccaaatagctcaatttctgctcatgagattcaacagatgaactgagggaacatatgccaatagctctgagattacaggtccgcatgggatgcccataagatgcaggattctattagctaagattatatgtctcaggtgggcaaatctttgtggacatagcaagaaaaaagaaaaactgtcaaggaataatatagagacagtgtgatggttaattttatgtgttaacttggctagaccacagtgcccaggtatgtggtcaaatataattctggaggtttctgagaaagggtattttggatgagagtaacatttgcattagtagactttgagtagagcaggttgccccatgtcatgtgggtggacctcatccaatcagttgaaggcctgaatggaatgagattgaccttcctggaagaagaggaaattctaccaacagaatatcttaggactcaaataacaactcttccctgggtctccagcctgcctgccttgaactttcacaatcatgtgagctaattccttaaaataaatcaataaaaatagatgatagatggatgattctgtttctctggagaaccttgactaatacagatagcatactaattcacccttgccatttatagaggaaagagtggagtaataaatatcagaatatcttctccagacctggtcaccacagaaacaaattatagctatgcaaaatatcttggaagtttagctgaagagatgaggagatactctactgctccatgtgcgccatgtcatctgttgtacctccccttagttaagtcaggagggcaacactccctttattttttattttatttcgtatgtatgtgtgtgtgagatggagtctcgctctgtggcccaggctggagtacagtggcgtgatcttggctcactgcaaccctgcttcccaggttcaagtgattcttgtgcttcagcctcccgagtagctaagattacaggcacaggccaccacctgtggtaatttttgtgtttttagtagagatggggcttcgctattttggccaggctggtctcgaactcctgacctcaggtgatccgcccacctcggccttccaaagtgctgggattacaggtgtgagccacagctctcagcccctctatttatcagacagatgtatagaaagtttattgtgctagcaagagtatgaagaaaaggattctctgagttgaaaaaacaaattggaatataaattggtaccacttctatggaaggcaaatttacagagcttattaattaaaataaaaaatgtgtactgtaaccactatgatacagcagttgcgcttccagaactctaccctatagaaatccgtgtacaaatagcaaaagatatttgtacaagaatgatgactgcagcattatttgtaatcgtaaaatcatggaacaaacttaatttaaaaaacaacatgtaaagggttagatgatggaataaacaaaagaagaaatgccttcatcaaaaataatgcagaggataataataatcttgagtctactgataacattattgattgagcaattattaaatctaggcacatcctgcaaatgcggtattattaccatcctcatattacagttgaaaaaatattgaggtacaaatagcttgtcaatagcccaaaggcacaaagagaagcaagatttcacccagaacccgtgaacagatcacacaaaatttctcttgttccctggtccaaggaacttctgtaccttccaactgcatttctttccaacagagaccttcttggaggatgagaagcagccactagttgacaggaggggaagtgaggcatgtagtcttcaagggagcagaccaccgtgggagttataaaagatcagcgacgcctctgggtgtgttcgaaccaccaactttttagttaacagccaaacgcgctagccgattgcgccacagagacatggctgagctcctgatttcgttctaaaagagggtaagctgtcactaaacgctagctagcaccatccgccttttgcaaaatgactgggtaatctccaaagcctcggaaagccggagcagtcagagcgacgaatctacttgtttgtcaagcttgaaacctgtgcactgagtgattccgaaacgccccgcaccccgccttgccccctcacctgcctcagaagccggcgcttccggagatgccgggatcgcgactcctgttagagcgacttgggccccagggaagctgaaacgcccagggtgctcaattaggacttgttgaattaataatacatttcagagacagaatatacaatcgaacaatggccggactgtacgtaaaaatataactctgatccacaacctggggccacctgcccaagaaatcaacttccttatctacgaataaacaaccggggaagccagcctgctattacataagtcagactcacagggagccaggcagttatctgtagtaacaaacaataacatccataataatcggctccaaatggcaagagcttggttagtaactgacactttccctaatttatgttcccacttgcaacttaggaccaaccagggaaagccaaatatgcacccctaaccaagcacactggatgtcccccttctagttagcccacaggcagcttccccacaccagcagtctccaatcagggcacacctgaagccttccctttcctcagctataaagctgtcccactcctctacctgccttctaagctctgtcaaaatgcaagtgccggtggctgatgccggtggctgtcgcccttgcgtcagaataaataaccattgcttttttcatttgatgggccttcgttttcacactttgtcatctttaagcttttagccctttgaaggattctgagactggaaaataaatgaaaggatttttcaaagggggaagttctttttttaaaggctttattctggtcaattgatttccaagtgtgcaatgtcccatggggtaggccacaaagaggcctagagtgcgccatctgtgcggctgcagctcctggctctcaacagaactgagatctaagtcctcatgatctgatcagcttccgagggcctaaacctcctattaccaccaacttggggattaggagttcaacaaataaatttggtgaggggacgcagacacacaaacattcagaccatagcaatgcataaaggtagctcatcactgaagttttaatttgtgtttccctaacgagtaatgattttgaacatttttcttacgtcttttggggtcagtgggcaagatcaggaaaggggcagggaccaaaggagacatgaagagggaaacagcagggacaatgacacctcccaggagacttgtgcagaggcaaaggctggatcctgagagatgagaattgtttttgtcatgtatttgaatgggaagaaatagaaaaaggacatgaaagagaaaaaacacaagaacttgtagctatccaagaacaaaacaggaaaatatcgtggatattttttcatcaaaaatattaaaagcagcccactggcaaccccaggtttatggtgcaccatgatgatataatagttagtgctcttcattgtgaccgaagcaaccttggctggaattggagccacagtagcatctggcttccttcttggcaagatttggtatgtgttacagtttcactttttaaatccccttaccaactgcacccagtagctgtggtcagaaagcagagtttactgtgtctccctgtgacgcagtcaggacaagagaaggaaacccccacagtgcactaacctacggcagaatctttggggaaggttagaagggaccgtgtgtctgagcatgtgcaggaaccatctcaaaaggtaaagccctgactcttcaggagccttgtctgtagcttcaactgacataatggtgtggtaataaccatttttctggctgagatatttcaaaggtcagtaaggcctttttagatgcaatgacaatgagctttgtatgagttctcattcaacagggtattttacaataaaatctgatcatataaaacccaataaatgtaatagaacctaaacttgatgccatcctccacctcccccacctaattatttggcgggggaacgggagcgctaatagtacattattgaagtataattcacatagagtaacatgcacaaatcttaagggcatagaaacgtaaccatcgcctagatcaagttatagaaaatttccatcagcccagaaaggtcaataacctcctttagattcccatccaccttcctttcacttagacaaaccattctgatttctatcttcacagacgaatgttgactgcttctgaaattcacataaatgaatatacttttttgtgtctgacttctaatttcctgcagcataatgtttttgagatgcatccatgtttttagtatattattttggtgttattgatgactgttatttctgtgtggatgactgggttatttccaattctggctctcgtgaacaaagctgctatattctagtacaattctttctgtagacatatgcacccatttttcttcagtttatacctggaagtggagttgctaggtcatggagtaggtctaaatttaactttattataaactgccaaacagttgtccaaaatggttgtgctattttacctcctcaccagcaacgagagtatagttactccacattcttgtcagtacttcttgtctttcaaatttcttctattcaagctgttaaaataccttaaactgagtagcttacaaacaacagaaatttatttctcacagttctagaggctgggaaatccaagttcaaggtgccagcagactctgtgcctgatgagggctcactctctggttcataggctgtaccttctccatgtgtcctcacatggtggaagggcaaacaagctccctccagcctcttttataaagatactaatcctatgcatgaaggcagagtcctcatgatctgatcagcttccaagggcctaaacctcctattaccaccaacttggggattaggagttcaacaaataaatttagttgggggaggcagacacacaaacattcagaccatagcagtgcataaaggtagctcatcactgaagttttaatttgtgtttccctaacgagtaatgattttgaacattttttcttatgtcttttggccatttagaaattttgtgtgtgtgaagaaagcctattcatgtattttgctcatttttaaatagcttggcttttattattaatgtctaaaagttctctctaaatattcaatatttgagttatttttcaaataagcatactgcaaatatcttctcccagccttaacaaggcttgccttctttcttgtggtaattttttgataagcagtttttaattttgatgaaatccaattttcttattttttgtgacctctaagacatctttcctaccctatgattgtgaatatattttcctacattttcttccagaaacatgtttttatttttatttttaaatctataattcttcttaatttcatctcctgatctcagcacaatgcttaaccactataaaatccacaacttgcagaccaacagttcaatctcccagaaacttgtataacccttgatgtaacatttacagtagtttcctgctgtgctctttgacaactatagatccttgcgcttccaccccactgcccccttgccttctcccttctctctcctcttttcacccctacaaggtgagaaaaccagaaagacctaaaactgaggagaagaaagacctggtctaatctgtgctcaagatattagagcacaagaagaagaaagactgggtctgatctgtgctcaaaccacacctgtattctggtttgtaagtctagttctgcccctgtgtggccttggataaataacttaaactttatgtgcctcaatctttcttctgtaaaatggggctaataagagtagtcttaggccaggcgcggtggctcatgcctataatcccagcactttgggaggccgaggcaggcagatcacttgaagtcaggagttcaagatgagcctgaccaacatggtgaaaccccatctctactaaaagtaccaaaattagctaggcatggtggcaggcacctgtaatctcagctactcaggaagctgaggcaggagaattgcttgaacctgggaggtggaggttgcagtgagctgagatcacaccactgcactccagcctgggcaacagagcaagactccatctcaaaaaaaaaaaaaaagaaagaaaaaaaaaaagaaaagaaaaaagtagtctatttcagtttgccattgttagctgtgtctggatatggttgacgattaattagtaatcaatcagaatgatcttcctcattgtcattttcctctgcattatttttgaaagcaactatgctgatgttttgcatcttaaattagtttttcttctaagaattccagtagatggactcatggagtatgcccactgttatgtccagttccttctttctgcataaagtctctgagttttattcacattgttgagtatatcagatgttcattcctttttattgctgagtagtattccattgaacgaatataccacagtttatttgccagtgtcctgataatagacacttagattgtttgtagttttgggtatgtgaataaaactgctatgaacgttcttgttataatgtgtgtgtgtgtgtgtgtgtatgtgtatgtgtgtacatatgttttaaagtctcttggaagaatatctaggtgaagaattgctaggaaaaaaatgtttatgtttaaatgtataggagactgtcaaaccaaagtgattataacattttacattccctctaaaaatgtatgagttctgggtgttccacatcttcaccaagatttggtggtttctgactttataattttgccatgctaaaatggcggagtggtatctcaatcttgtttaagtctatttctctcacaactaatgatattgagcactcttttatgaactgactggccactagtatattttcttctctgaaatgtctgtttaagcttttgcccatttttaaaaatgggtgtaggagctaattgtatactctggatacaggttcttggtcaaatatgtgttgtgaatattttctcctcgtccatggcttgccttttcagttacttaatggtgtctttggatgaaaagacatatttcatatcaacaaagcctaatttatcatttttctgttttatttatttctctgtgtaatatttagaaaatatttgctttctgccaagtcttaaagacattttcatgcattttcttctaaaacttcatagtttgtatggtttgttctgtgatccaactcaaattagcttttgtgtatgttgtgaggtagggattgagatttttttcctcactagtagatatctagttggtccagcactactcgttgaaatgacacttcttccccattgtattactttagtaccttttttgaaaaaaaaatcaattgaccatataacaaggatctgttttaggtgtctcacttcagtttcatttatcaatatgtgtatccttttgccacattcacactgttttgtttatagtaataaacagcttaatagtaagtcctctaggtttgacacctcaataaacctgaaatgtgtacatcctatggtgccaccatgaaaatcaagacatgctgtcacttaatctctctcatttcactagaggacacatgctctcataaataatggttgaccccttagccaaagatcctctattgtaccctctggagaaaataaatctctagttaccttaagagctgatctagaggtaaaatgtctgcaacattcagcaatgaatttagattttctttgaaaaaaagttcattttcaaggtagttttttttgttttgttttgttttgttttttttgccaaagaatttcttttttttctgttacttagtagcgtgaagtacaatgtttggtttgcaatttctgttctttgtaggaagaaaaactttagtggaaacaaccagtacttaaagaccattttatgaggctgtcatttacatattatctcttttgctgtttttgttaaaatgatataaggtgggctttatatgctttctgtataacctttggaatgtgtatttaaattaaaaacgtaaaattaaaatattcatcctagactcaggttaagttccaccaacagtacacttaaaataggatgagcccaacctaagcgtacaacctacctgcttcaagtgtgtagttggtgtgtgtgatacattctcaacagtatttgtgttccctggtgtagtgattttcgtgttactcccacccttgaaagtcctcgacttaaaacccatctagaacatttcctttgctaagactttaaagtattctttcttcaagttaagggtagtttttaaatagttatcagttgcattcttggaattcacagaaagcttggggagaaacaatccgacggcacaagttcaagtgcccaacggggtggagaagggactgcatactcactggttgccaggccgaggttgtccgccttgcctgctttggctgagactggagacggaaactccattcaacagcgactggaggactgaaacggcgcaagagggcggctgcccttcacctactggtccctccctgccttggcgccttcggagttcggactgacccgggatgttgctggagccggcaggaactgcaaactcaccgcgcgcgtccctgcacacccgcacctgcgcctcgagaactcctggccagttgaatacccggtctgccgccgagcttcgctgcaggtcacaggaaaggggtgcagggttgcgtacccggcgggggaagccgcgcggagaggaccaggtgctgctactggcctccgagaagacaggcctagagtagctgattttgacctgcagggccaaagtctaacggcggcctaaaaccctaacgtctgggcgagccgcgggtagcgagttgaagcgatctctatgccttgcttgtcgtttgccaaaattcagaccaagaaagagaatagttgtgtggatcaaagtctgcaattaaccaaaaaagaaacatgatcctgtgttagcttacttaggaaaaaaggaagaaggaaggaaagaaggaaggaagggaggaaaggttggagggagggaagaaagatgaaaaaatcaaccaaaaaaagaacataatttcctaactaatcggatgtgggtcatgagagaaagacctgcgtccagtttttggcctgaacgtgtggagggtggagttgccattaactaacgtgagaaaaggcaggtgtagtacgttgtagagaaaatatccggaattccgttcagggccctggggtcttccttgaaagagttttccatccaggccgtctcggtttccgcatccgtctgagtcgtttatgatgtcgggaatgcaggaatctgagtcctttatgatgttgagggtgccacggtctcaccccgggcgcctccccgctccagcctcctcccggaagcctggtgcgctctggccccgccgaccagcgacagtctctccacgcgctgccgcctagcaaaggagcatctttaggtcggtagtgaggtgcggccgggacgctgcaactcgctccgggacttgtaaacctggcaggtgttcgaggagcgccactggctggaaggaaaggagagagctctgcacgtcgcgtgtgggctcgcaacttggagaaagcagggagaggacagccttttgggactattccttggatgggcgggtggcaccaggaagggtagatggagctttctagaggtcaatgtcagcgtactttctgctgaaacaattgaaggaggaaaaaaaaaaagtatgtgctttgtggttccctggtagtctagtggctaaagtttggcgctctcaccgccgggactggttgattccagatcaggggactgggtctcggcctcactgtgaggtattgttctttcctgtgtttgccatctaccaccgctgtggctcaattatttcaagactgctggagaaatggaattaatgtcgatcctaacatttaagctatttatctaggataaattccaaatagtggaactgctaggtgaaatttattgtgaatttaagattccgatgtatacagccctacaacgtataagcaccaattacattccccaaagtgtgtgagactgcgtcttttccccagaatttaaaaccaatgctagaaattatcagacttttagagataattttaagcttatttatcatcaaaggatttcttcatagtcaatttccccttagactataaatccgcaagagatggcaaagctggaagaactgcctagaatttcagcaaacttgaattcaatagtctctctgttctttcctgttttggcacctacccttttcttccagttaagattggacacaatagaaaaataattaataaatgtaataaaaatgtaagcctggacgttttgctcacagtgttctcactgggtctaaattttgtgaatgtggttccttggatggtctcatgggtatgcttgagactttaggcccttgggacacctggtgcacagaagggtcccaaaacccatctttggaagtgttggcagagtaaataggcaccagtaataaaggcaacggcgcctgaatacgtaaggctggtttaaaccaaagcagatttttcaaaaccagagagggcttgtgttcataatttaataatttaatttttattttgatgaaatttaaatttgatttaaattttcataatttaattttcattttgatggccactttattttgacaaagacactagtggaggaaagtctctttatcggatcatcaatttccctataaatctttgtctcagaaaaatttaataataatttcataataaattataataaataatgtttcacatcttacattattcacttttgatttagttggcttgtgctgtcaatatgttgcccactgtataacactacctgatgaattacattcaactatgtagtaatacatattactacatatacacacacacgtatacatgtgtatatacatatgcatatacacacacacatgtatacgtgtgtgtgtatatatgtatatataaccatatataatttcaaaaggtaaattaaatataatgggacagtgttggtaacctcttagatagtgtagggataagatagctgaatttatggcatggtgttgtatacttcagatatctatgctgtaatattaaaatggcatttccttggcccactaaattgtccacttcctggcccaatatgatacacgaaaggaatgaaaatgggaagaaaatagccttctgaaggacttgcctaataaacttctcccttagcattacttggagtgacatcagaaaattggaatgaagtaattgtgtaaaaaagacaaattctctgctgtctttctcccccaatccttaataaacaaaggaggaaacctagactcaggttaggttttctcttcttattctttacataccaggacaagtactgagcttgtttgttactatatggggacttagtgtattgtacaaaggggtgtggctattactgtcccttttctaccagagcatcaaaactggtaacttggctggtgttaaggggagcttctaaccttgaattcccactccatgtgacttctttctggttctctcttctcagagaacttgcagccatcagattcatttggagaagtttgataaaggtgactttacgcttagacagaagaaaaaaccctaaggtcttgaactaagccttatcctctgatacagtttactggaattccctccactgtggcacaagccctgccataaattgtgattatctataccttgtcagttttatctgtgtatatatcttttacagtaatccccacatccaccagagaacctaggttattggcagaatgaggtttgggaattttggtcctctggccagacactatcagatagtactctgattccaccatttttgaaattatatacaacaaattttaagtattgtttattttggagagttcaggttaaaggaaatgaagactattattcagtattatttctgtaattttgtaattttaaccataacataggtttcttatcaaaatgtatggaagccagaaagcagtgaagcaacaatattttctccaaaacaaacaggccaaactttggcaggagtgacaaatctggcatgcaatggtggcttctatatcagaaatcaagtcttttactttgtgagaggcaggagtttttagttctttgtcttccttttggctgccagaggaattgaacattgtgaattcattggcatagtcccaagaaactttacttggcaagcaagctattgattttggcgggggtgggatggtgtttatcagtcacccctactagcagagatgtgataacactgcagtcagagtagttgagttttaaaattttgacttgccaaccaacagaacattatttatatggtaaaacttagacatcagaggctacaggcactcaggctaaattctgacccattcattggtgacaaatgttaagggatttttgtcccattagccctttttttactcatgatggtactctgaacagaagaatctcctctaacaatttaagaccattcattgtataagcatgtaaatcatcaatctcaatgacacattttcacaactatacactgaattggctcagaggcttcactcataactttaactttttttccccctttactacaagttttacccaaactctgtcagttgaattcacactctacaggaacacatatcaagaagtttaacacatgcactttagttacagcagcacctgccaggagaatatcttacctccttgactgagagttcaaggagtgcagggagatgtgaccagccatcaagaagcagtagagagacttctttccttaaagtacctgagtcaggttgaggggaagagaagaattaggagcacaaagagagcaggcacacaacagaaagcacaactctgcaattgcttttggttttaagaggctgtccattcagtttttttttttttttttttttttttgagacggagtctcgctctgtcgcccaggctggagtgcagtggcgggatctcggctcactgcaagctccgccccccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccccattcagttttttgtttttttttttttttcctttttttgaaacggagttgcccaggctggagtgcagtggcatgatctcagctcactataacctccacctcctgggttcaagcaattctcctgcctcagcctcccgagtagctgagattacaggctcctgccaccatgcctggctattttttctatttttagtagagatgaggtttaaccatgttggccaagctggtctcgaacccctgacctcaggttatccacctgcctcggcctcccaaaatgctaggattacaggcatgagccaccatgcccagcctgtccattcagtttcaatgaactttaaacaacaaaaaatgccatttgggtggctggtttcagtcttccctgtcaatgctcagcctccaaatattcactaacacacagaacaataggaggactgttactctcctctcacacctactacgtgggagagaacatctgctaccagatcctggaggcccttctcaagccccctaacctggccccatgtggttctttctgttttttctcctagaaggcattgtgaccttactggtcccatgttgggcatcaaatctgtgaatggctcacacttggacttacgcacacagcataagtaataggggatatctatgcataagaaagattagtatgttgtcagctccccacatccataattccacagcatgacaccaaactggagttactagatgacaacccaagtggtgggttgctctgtcaagaaggggccaattttatattgcagctaggcagttacagtctgtagctgtaccattgaggggatcggggcaagatggaaatttccatggtttaccagaaacaggtgagaaactgcctgctggtagcctgctgcaagacaaggaggcccccaaaagagatgagtaagaaatagtattatgataatgcctcacaagactacttcccttaccatggtccaggagggcatttggtcaaggtttgagtcatagtatggttgagccttacctatgtaaagtttaagcaaagccattcccttgtaccttgtaccttgaagagagtttcattggatataatatccttaatttgcactttcttctttttaatgagtaaattgcattttattttattttattttattttattttattttattttattttattttattttttgagatggagtctcactctgtcgcccaggctggagtgcaatggcactatctcggctcactgcaagctccacctcccaggttcacgccattctcctgcctcagcctccggagtagctgggactacaggcacccgccaccatgcctggctaattttttgtatttttagtagagacggggtttcaccatgttagccaggatggtctcgatctcctgacctcatgatccacccaaggagtctctctccctccttgtgttctggtctgtgaatggctcacacttgaacttactgtaggctcctagtgggaggagcgggggtggcgaaaatcctcatcatatggataaacataacccaaacctctagaggtttcataattttcctcttgcttctaaaaacatagtcatgtcttatggggtgttatgtactttatatcttaacattttccacttgctgcttcttggtttgaggggagaaatgccagcatgtggcaaatggagaataagactgatggaagcctcagggcaaggccttcacttcccagtgacactgttcccaattccctccagcatgagctgagcctcctcaggctgtggttgtgcagcagacagggtgtgaggaaaccctgctcagccctggttacccaggatggcactgagttctaaaacgcaaaggttatgtggtgaggggcctggctgaagacctggtgtggtacttttgtgagcagtggcaccatttgaggctgggtaggagagaggtgcagggcctagctccccaaaagaccaacagataaactggggcagagagagagattccagtgtaaccgggaaggctgcagatcataacaactatggctgctgatttggcatcaaagatgtggcattgtcaaagccacaattgttgagaatggcaccaacatgctgcagctggagagagtgggtgaccaacattttgaagtggcatagttgtctggggtaattacccaaggtttgttgcctcacaccaagggaactgaggatgtggacacacaagaagtgggtttaggagtggaggtttactaggcaaaagaaagagaaaggaaaatagctctctctcctgagagagagagggttgccagagtggaacttctggttttgtggtgaagtgcacagggttttataggctggcttgaggaggcagtgtctgattcacatagggcccaaagattggttggaccaggtgtgacatttacatagcgctggaagaagttggccacccaaccctaatcttcttcttatgcaaatgggttttctactttactcatgccatgttgtctgctccttactgtacacgtggttagaaaggaaaagggaagatggagccaccatgttgaacatgcctatcccccaggtagccttgtcctattggcacagccgccagcagtcacctgtgcaagcttccagcttgcttatctatgtctgcagctccattttacaggctgctttttgttagaaaagaaattatttgggggctgcttttcattaaaagggaaccttaccaaggacttccttaccctaatgcctaaataatttctttttaactcctatatcaatttgtttgaagaacagatgacactttgaatggcccagcccacagcccagaatttcaagggaagaccttgaattcaagggagacaatgtctcccgtaaaatcacctaggcacttacatagcatatttttctgtccactgtcttgctagtctgttgtagttctctctgttggccttgtaggtgtggggtatctctagcaccagaggatcattgaggttggggatgcagggcagtgagcagatggacaagagaacttttgacagtcaatgctggagaccactgagaccataggatgtcgaagcagatgctgtcattgctattgatattggggtgataaattttggttgtgaaagcaaccttgggggcttgaacaggcaatccgtaggaaagtggatggtcaggaagaaaacacctccttggcaaggactgtcattaattatcacccagaggccccgtggagcactgggcaggaggattcatctgcaagttggttaattccttctggatccactttagtgccatcctaccccactgctgggggctggggtggcccagccacactgcactttctatatataagttttttgaaaatgctgcttcactgttaccttgccttgtatgttagtgcccatctaattcagttgctgttgtaacttgttccacagtgatgcctggagacctgagtatgttttatctttaaaatctaataattttactaggatattgtcttgaagttgatcatcctggtttaatttttgctgccactttatgggctctttcaatgtgcctcatcacataagtaatgtcattttcatttttgtaaatcaagtctcctagatcgttcacctgaaagcctgattctcctttagagaaaaaaatgctaaaaaacaaaacaaaacaacaacaaaaaaacaaaacattatatatcgcattacaattttattcaacaaatacagagatttccagaatagttaaaacaaagtagaaaacaactctggtgttataagagcagtaggttcatatgcccactgtgcagtaatagaccaatacactaagacagcagtttgcaacaaagaatttaatgatcacagggcagccaaggggagagatatgagtagaccctcaaatccatctcctcaagaacttctgcgttagggtttttaaggggattgtggagggtgaggggttggaaaattaaggttgttgattgggcaggggaagggggatgaaatcattaggatttggaaactgcatactgagtcagttcctcagtggggtccttcagaccagctgacatcagtagtttcactggtacacaggatctgaaagaatatctctaacgggaaacttaacatttcataatcttcaggttgttatctatagaacagttcaggagaactataatctagggcctgcctgattctagcacaaacagcaccaaacaactgtgaggaagcaggtccaagagcaggctgctctcaagagtaatgcaaaattgctgcaagcttgtttatttttgtttctccccttcccttcttccctgattaattttataaagtttatagggacagtttcaatggcttcaacacagtattgccaggtaaggacttgaacccaagaggcggaagttgcagtgagtcaagaccaagccactgctgcactgcccagtctcaaaaaataaaaataaaaaaaaaatcaggccaacacctgttgacacacattgctaggaatccctttgggaaagcaaatgggctcacggaacacacggaggccatggtgggtgacaatgttaactaattctgttcatggtgtccagggtacaggcctgagggtccactcgccacctctgcccaaagccacgtctccactgctcccctcatctccgcacggattcctccccacgtgcctccccttttcttggactgccgacacctgacaccaccaaggtgactgctcctccccacagcttctctccttcaggggacttcacttcttgttccttgctccatagtgaggcgtgacccagcggtcagcccaaggtctagcatgcgaatcagggacgtgatggttctttgggattctagggatctacctggaaaatagatgaaagtaacaaaagttttacataccaatattcaaaactgcatcaaactaccagaaacacttgccactttcaaagatagaccatgctaagtagctccaggtgtgtgccaccatgcctggcaaatttttgtatttttagtagagactgggtttcaccatgttggccaggctggtctcgaactcctgacctcaggtgatccacctgccttgacctgccaaagtgctgggattacaggaatggctcttgactctaactgcaaggtccctaaatcattagatcatttcctgaatatcttatgcttcaggcattggccatcacttgggttaccattgtcataagtcaaaagcctccacaaccaaggcccttaaacatgggatagcctgtgcagggcagaagtataaagaatatagagaagtgaagcacaaaacttgttgcattggccaggaattaaaccagggtctcctatgcaggcggtgagaattctaccactggaccaccaatccggctcttatgtgtggtcctggagaaacaattgaaatacaatactgaaaaagacagaaattgttccaaaagaagctttttgcagtattgactaaaagctaacagtagacatccaaaaccaaggtttttatagaatacttttactagacaaaactataaatattaaaatagcttatttgatcaaactttaattcctaaaaaggctccttccaactgcgtaacagactcctatagaaaaacatcagaaattcatccgggttccttgtttctgatcctaaatcttcaatttaggacctcaacctcaaactgttgctttagtggctctgggaagaaagcactaactggcagcataggtaagtaaagttttaatctagggaagaaataagaagcagaatcagaattagaattagaagaaagaggaaatatgctataccagaatatcataggcaaaaaaagaagatgaagaaagaggaaatgaaaggacagaagacaatgctaatggagttagttatttgtggctgttttttgtaaaagagtaatgatcagtcttgtaatcattataatactattatttgctttctaaaatgtctaaaatatttgaaggaatatatgatataaaaagatgaataatgcttgcagtcagtgtttcattgtttgggagaacccagtttcctcagttaatacattttcgtgtaatagctgtttaaggagtaacatggtttaaagacattttaatggctgaaatattaacatgttggtcttttgatgaagttcaaatagaggatttctttccccaattttccctggaaagattaaactgaagagaaaaatctggaaagtttgccccacctgttgggtctgggagtcattatgactttttcaacgacaggagttgtgtatgacatggaatcatgcttcttctctagttgagaagccaagctaggtccaggctgagtcataaacttgaacccaacaaggaaatcacccttcatattgaccttgcagagctttggctctatctgttctctgcccaacacccaagacacatactagttctggccaacaaaccttcacatattgtctgtgtcaaccagagctacatttattcccaaatctctttctaaaatacaaacctgtactttctactctcaaccccaaaatttacaagaggcctcatatgcatctcagagtcacagatgctaaaactcaacacaccagtgagatccctgtcagcatcatgtactaccctctacctcaatgatcagccccaagccagcatctcccaaagagtagtgtgttgtcgtgggtgtttcaacagatcactaaaacctgcttctaccgctgcctagacacctatcctcactgctatgcatcctgctcctcaaatcagatcttgatatcttctttaaacactcccaatctcccaacatgacaattcatttccaaagaattatagtatttaaatttattggactctatacagactcattcccactttgttactacgctggtccatccatcacctccattaacataagtagatcaaaaactggcctctctacagccagtcttgtctattccaacccatttgccacactgtgtcctgagtgacctttccacagtgtaaatctggacatacctgtagccttaaatcatatctaccaacatagtagccaagcaacagcaatctcttttcctttggtcattagagtcctagagaccaagaggatgttgggaaaagaattacaatggatcagctctcagaggcagtgggttctggactcgtgctggctttgatacgtgtacattggaaaagctcaagtacctggcaatacttggagattaggaagaaaggatgaaagtaaaccactgcactaaataacatgacaataatcacttatacaaaaattttaaagataaggaatatttaaagatttattagtttattatagctttatagttggagagtggagaagaaaataccaaagctttttgtcttaacaaaatggtgcagacagattaacatatattgtcacctatgataaccagtcagcataaaaagtatttagaaaggaatggttgtattctctaagagggatattctgatgtcatgttttttgctttagagtctattaatatagccacctttttgttaatgttttcagtcaagctccttttctcgcctttcatttccaacctttctctcactttctggtttagatacaactcctaaatatgtcatatagttaatttaaaaatccagtgtagcagtatttcgggggtttgttttactggataatttggtccacttacatttaatgtaattgttgatatatattaattttaaatctaccatctttattttttctgtttgttctgcttgttctgtttctatgtcttttcttgtctgttttggattggttatttttaactattataacattatatttttttacttttttatatgctttgcttcactttcttccttattgtatttcctttaattgtatttaagttgcttctattcttttgtggttactttaaaaattacaatcttaatctttaattttttttttttttttttgagacagagtctcactctgtctccaggctggagtactgtgccgcgatcttggctcacagcaacctctgcctctcgggttcaagtgattctcctgcctcagcctcccgagtagctgggactacaggtgcagctaatttttgtatttttttagtagagacagggcttcactgtgttggccaggatggtctccatctcttgacctcatgatccgcccaccttggcctcccaaagtgttgggattacaggcgtgagccaccgtgcccagctaatccttaatttattaaacatagtagtaattgataccgttatcctcttcctggacaatatatggatgttggaatacttttattccatttagtctcattctatatatatgctgttatcatttattaggtctaagtattaatagttttaaaccccagaagactagacatatattttatgtagttaatgttaatttagatttatcaacatatgtgctgctatcttgctctttatttctgctatgtctctgaatttccatatgtaatcatggtccttctgctggagaaacatcatttagaatttccttttgtgttggtctgcttgtgaaaaaactgtttcagctatttttctctgaaagtgtctttattttgctttaattagtggagattatttttactaagtatgtaattctggaggcagttattttctttcagcatattgaagatatttgcatttgattgtttctttcagaaggcagccaattgtctcgctgctgcttatttgaatgtaatgttcctttttttcctctgttttttgtctttactatttttgtctttttttttttttattgtctgcagttttactattctgtctttaggtatggagttccctttatttatcttctttgattggtaggccttctagaatctgttgacttttgagtttcattttgtctggaaaactctcaagtattatctcttcagttattgcctctattttctctctcttctacttttgagcctctaactaaaaataaaatagactttctcactctatttgttatatttttgtgtttgtgtattaaatattattttttctccttgttatatattctgaatttttttcttcttcctcatctgccattttactagttctcttttcagttgtgactgctctcctgttaaactcttccattgagctcttaattttgttttgttttgttttttccgaatttctatttgcctctctctaaatctattctgtcatttttttgttgtttccaattggtgtgtaaattgttaacaaaacccttttctccttctgcatgataatttgaccttaattaactttctagctctgtccacctagagccttctaatgacaaaatgtcaactatgttactaagcaaacattgcatatcataaaaaagactcctaactgatggactacacttggactgggaaaactaagtatctggaagaagccagactttgagcttctctgaatgcagtgactcctataacttgcatacacctggcatgggcattggaaactactctattaagttcttaacaagagataatggctccaggatggtgccacatgcacctcagctgtccccaagtagacaatgaggggtggagagtcaagagactatctcctaggtactgtgtggactgctgctgcagggactgctcctatagaaatatcatgcctgatgctgccctaatagcaagctataattcttatcctacatctctcggattaatctggtgccaagtatggcctctgagattcttgtgagcctgaacgttaagttgaagctaagaaaacatccaagtgggcaaaattcttccaaatttttgtttcatgaataatgtagacatcattgttttgcagtctttctaatatatctaatatttgggggcttgatttcaactgcctgacatgtctgctggttttcacacctggtttagtttctttgggttcattattatttttgagtatgtgccatatcttgtatctggaaaaatatttttggaataatctgagatctacaatgaaagctttcttgcccagcacctgggggtacttccagcccagaaccacctttaatcaagtaaaaggtgtgaaagatgctctgaacttaaactgtgtaacataagggatgtttcttttatagtccatttttatcccaagattatagaaatgtaaggttctaccttattgtaggattattctcctgataaactccccaacttgggcagactctggtcttctatttctgtcccattagtcacagaaggctgtcaaaccctaatatgcaggtcaggaaatgtccttagccaaaaaatggttcctctgcttgcttacggctctgggatccagtttttcctttacttcaggcctcgtaattcttcagtgttaatcatcatcttgatgcttttaaaaatatttgtttcctatatattacctaaatagcttagtcagtgttaccagaaatgtatcatcaacttttaaaatatactaaatgcttaaaaaaataaagtcatattttactgctatggctctgacttgaaactaagttgatgaggccatgagctggagcacaaatcagtccccccactgtgaaactgtcaggtcaccacaaatacagattttattagcaatgcagaatttttcttttccctcttaagtcatccagtgaccaatcggttctaggccacaagatcaaaaactccggtctcaaaatctaacaacccccagctggtaatctcacacatgctcagattttactttgtaaaagagaatcaagccacatcatataaaattaaacatttattatttttcttaatagtctaatagagatatacatttgtgtatattggccggaaattgggctaaaattttcacaaatggaaatcaagaatgttaccatagaactatcaatgccaactttaactatctgaatcagatggcatagcctagtttcctctacaactgacagcacactctttggtattttggtatttttcagtgtccttgaaatgtttaactacccactaaagaacaggtcacatggaattaataaacaaagggcttcagtttccatcaagcaccttcaagtgacaggaacagggatttaaataaaaggatctaagtcagcacaggaaagtgactgtgctgccaaagtgactcaaactcaaaaggacaggatgagacttactcagaacttcgaggaagtgtagagaaattatccaccactttttatcctagaggtgcctttgtggttgtgaccataccgtagaatgatttggggatcccttccaactggaaggacatcttagactgagggaacccaagaaacctgatttcggtcacccctgaccatcataaatcccatgcaacaggtccatgcattatctaatgttgactctgggaatggtcattgtcattgtttcctatttgaatggttgtcacatttcctgcttcaaatgatatccagaaatgatggcttgggaccatattctcaatttttaggtggcaaatagactccagagacatcacacataataaaatacttggactttgaaaggaaacagtcaagtctatgacttacaagcttataaagatccctcagatgagttatgtacatggattgagaatcagaaaaggaaggatgctctctcaggagatagaaaaaccagataaaaggagcaactgaaattatctgacccatcccctcatcgcctatgtagaagggaaatgctcactttatctaaccagtggataacagacagcctctttcattttggagctaccaaaaagaaaaataaattgtggtttggttcagttcccttttgaccagtatgttcttgaaattttgaaaacattttactctttttccttttagtgtttcagtgtggataatttcatttgatctattttcaagttcattttttaggccaaaatttgtcaaatattggcaatttcatatgattcaacttaatatattaacctaatgtgcaaaattcaaatttgtttctatactactaaataatatccccctgaaacgctttgccaatttactcctactgacagtgtatgaaaatatccattttatttcatcctttacaaggtgctattatcaataatttatacttttaccaatctgggaagtgaaaaagacatttaattgtcttgacttgcatctcccttattactggttagtttaaatttctattctccgttcatttttctgtttattttcttttgtagtacctactacttcttgatatctttgtttaagctttatatatttactttttacctgttaattgttgtaatcacccactaaagagtaaattctggctgggcacagtagctcacacctataatcccagcactttggaaggcccaggtgaatggatcacttgaggccaggagtttgagaccagcctggccaacatggtgaaaccccatctctactacaaataaaaaaattagccgggcatggtgatgcacacctgtgatcccagctacgcaggagactgagacacaataatcgcttgaaccagggaggcagaggttgcaataagccgagatcacaccactgcactccaacctgggcgaggaaaaagaaaaagaatcagttccatcagagcatggattaagtctcattcaccactctagtgcctagaacattttatgtactcaacatataatagttaaatgaatgaatgaaagttagactgtaggggtgtccatgaaagtagatattagctaagttcccagagattgactcctcttttcctggttctcacacttcaagctctgttaagcctggaggagggtgttttgtctttaaaaagatacagctccaggttacccctttggaccagttcctgttcttaggtctcagacttcctctattcatgaatggtggatatatatgatttcctgtgatgtttctttacattatgaccataatgagcgttgatttttagttcctgatcccctcatgtaatgactgttcaattaatgactttttgccataatggctattataaagctatgtcactttttggacaactccttttttattataatgatttgtcaccccaaaataaataaacatgctataagaaattatattttgacatcatggtttcaagcagacactatatagaaggatgtggccgggcacggtggctcacgcctgtaatcccagcactttgggaggccgaggtgggtggatcatgaggtcagaagatcgagaccatcctggctaacaaggtgaaaccccgtctctactaaaaatacaaaaaattagccgggcacggtggcgggcgcctgtagtcccagctactggggaggctgaggcaggagaatggcgtgaacccgggaagcggagcttgcagtgagccgagattgtgccactgcagtccgcagtccggcctgggcgacagagcgagactccgtctcaaaaaaaaaaaaaagaaggatgtgtatgaatgagcaagtagggaagtggccaaagaggggcccaccctctgtaatctgctttttgatgctaaggtgaggactctgcaaaccacatcttttttttgcttgctggctttattagtttctgtcagtaaggggtgttaaaaagagactgaaaggctggaggagggatataggtctggctgcttcctattttgtttcttgtttcaattagcatcatcccagccataattttttactctgagagtggtcattgtttccagtttcatttcttttcttttcttacaatcccggagcctcatggccccctctcaaaggcatgagcatcagccagtggacatctcttcttcagaggtctgagtccctgctacactaggtacttcctctgagttccaaggccagcagcaacctccttctcagaagccatcctcccagttatgtgtggcccttcatccaagttaccaagttctaacaacccaaccattttacctttgtttctacaaccctagggttgatcactgcttcgctttctacactaactatctctgtgttacatcagttccccttttgccttcttagacctccaatacctgtataattccttgtgttaaattccctctggtatactgttcattttctattttttttttttttttttgagacagggtcttgctctgttacccagactcaagtgctgtggtgcaatcatagctcactgaagccttaaactcctgggctcaagtgagtgtgccaccatgcccagctaatttttattttttttagacacagtgtctcactctttttcccaggctaatcttaaactactagattcaagtgattctcccattttggcatctcaaagtgttgagattacaggtgtgagccaccatgcccagcccattttccttttagaccctgaatgacacacagtactactcaccaatttacctgacatgaccatttgtagtcagagaatattgtgtgaaacaactttgaattgcatgactgtattagtctgttctcacactgctaataaagacatacctgagactaggtaatttaaaaagaaaggagacttgattaactcacagttcagcatggctggggagccctcaggaaacttacaatcatgacagaaggagatgcaaacacatccctcttcacatggcagcagcaaggagaaatgcagagcaaaagcggggaaaagtcccttataaaaccatcagatctcgtgagaactcactatcatgagaacagcatgggggaaaccacccccacaattcaattacctcccactgggtccctctcattatgtggggattatgggaactacaattcaaaatgtgatttgggtggggacacagcaaaaccatatcattctgccctggcccctcccaaatctcatgtcctcacattttaaaacacaatcataccttccaaaagtcccgcaaaattttaactcatcccataattagctcaaaagtccaagtccaaaatctcatccaaaggcaagtcccttctgtctatgagcctgtaaaatcaaaagcaagttagttacttccttgatacaatgagagtacaggcattgggtaaatacagccactgcaaatgggagaaattggccaaaacaaaggagctacaggccccaggcaagtccaaaattcaatagggcagtaattaaatccttaagctccaaaataatatcctttgactccatgtctcaaatccagatcacactgatgcaagaggtgggctcccatgatgttgggcagctctgaccctgtgactttgcagggtacagccctcttcctggcagctttcacagctggcattgagtgtctgagtcttttccaggtgcatggtgcaagctgtcagtggttttactagcctggggtctagaggatggtggccctcttctcacagctttactaggaagtgtcccagtggggactctgtgtcggggctccaaccccacatatcccttctgcactgccctagcagaggttctccatgagggctctgcccttgcagcacacctctgcctgggcatccaggcatttccacacatcccctgaaatctaggttcccaaacctcagttcttgtcctctgcacacctgcaggaccaacaccatgtgaaagctgccaaggcttggggctcgcacccactgaagtcatgactcaaggtgtaccttggccccttgtagccatggttggagtggctgggacacagtgcaccaagttcctaggctgtacacagcagggaggtctctgacatgccctgaagaccttttccccactgtcttggcgattaacatttggttcctcattacttatgcaaatttctgcagccagcttgaatttctccctagaaaacaggtttttcttttctaccacataggctgcaaattttccaaatttttatgctctgtcacctcttgaacgctttgctgcttagaaatttcgtctaccagatactctaaatcatctctctcaagttcagaattccacagatctctagagcagggggtaaaatgctgccagtctctttgctaaagcataacaagagacctttcctctagttcccaactagttaccatttccatctgagaccacctcagcctggactttattgtccatatcactatcagcattttggtcaaagccattcaacaagtctctaggaagttccaaacgttcccacatcttcctgtcttcttctgagccctccaaactgtttcaacctctgcctgttacccagttccaaagttgcttctacattttcaagtatctttacagcagtgccccactacccagtaccaatttactgtattagtccattctcacactgctaataaagacatacctgagaccgggtaatttataaaggaaagaggtttaattgactcacagttctgcatggccagggataccccaggaaacttacaatcgcggtggaatgggaagcaaacgtgtccttcttcacatggcagcagcaagaagtacagagcgaagtgggggaaaagccccttataaaaccatcagatctcgtgagaatcattcactatcatgagaacagcatgaaggtaactggccccatgattcacctacctcccactgggtccctcccatgacatgtggggataatgggagctacagttgaagatgagatttgggtgaggacacagccaaaccaaatcaatgacatatttagatgaacccaaaatactgtttttcatacacatgccaagcaaagtgaatgagagggttgcatcttctatgactcttcaatctgctgtacatgttcaccatttcaatattctataaagcctttttgtgtttagcttttatttggtcaaagccttaaggtaaaggaaattattaatcacattaaatttgatattgaatgctggtctggcactgaatcttcactgactttgaaagaataatcccctcccagtcctcctctattgaccatcacctataaccaagtctcctcttcctcctttgatgaatacaataaaaattcatatgtgaaaactgtatttattttatttttatctattatttacataaatttagtttgtttaatctatatgttttctatcttttgggtatcttgggttaatttttctgtttagaataacaaaaactttttattcacttcacatattttcacttagttgtaagattttcaaacataaagtcattaagcaaatgtttgtgtacaagacacacagatacagaaactgccaggagagactctgataacttccatacttctaattttgcatataagctgtcttcaggatacacaaagactgagggaagagaagatgctaaatgtaaataatatacatttatttatgtattcattatcaagcatatgttatctgaatgtctttataaagcaatatacaaatagaataggaacgtgatatatttacttccccagttgtggtgtaagcatcctctaaaaatgcttacaccacaattggggaagtaaatatatcatgtatataacgaatagactataaaaaagaacacatggggcaggtacgacggctcatacctgcaatccagaactttgggaggccaaggcagatggatcacttgaggtcaggagtttgagactagcctggccaatgtggtgaaaccccatctctattaaaaatataaaaattagccgagcgtggtggcacaggcctgtaatcccagctacttgggaggctgaggtggaggatcccctgaacctgggaggtggaggttgctgtgaactgagatcacaccactgccctccagtctgggtgacagagtgagactccatctcaaaaaaaaaagaaatgaaaaagcaggaacacatgatagggtagtctgagctctgtacaaataggaacagtaacatagacaaggagtaattagagtaggctgaaaaaaaaatcgaaagatcttcttgaaaaagatcctgaagaaatttatgaaactgagttgactaagggaataaggaagcacgtgagtaaatacagcaacattacctaaattccctttccatcatctctctgtcatcttctcccacctctcctaaccaacccacagggatttaaaaatattattgaatttttatctaaatgtgatggaggatggacaggaagagaattactgattactctcagtcaggattcatcctagcagcaattatttgtaatttaactgaaataagtccatttgactgaacagacagcttggaaatcactaaaatgagaaaggagatgttttagagagtatgacttctataagtgaatgaaagagaaatcacccttaaactcactggtttggggaagtgaagttcccacaaatgtgacacacaggaaattgcctttccacatgtgagttttctgaactgaaccaactgccatcgatttgcactagtaagacagtattcctaaccaaagcagggaaaacaatgatgtgatcccaagaagtccttgcactcccagacttctagtctcatctgtttaatttgacattgtagggaccaagaaaaagcttccccttctatcctctgaaagtttgctgaaaatggactatagacaaattaataggagaaaaagccatacaaaatgtatttaacatgtatagctcaggggaattaaaggaggatggttacccaacaacccagtaaggtccaaatggttatacacccttcctcatagagaaaggggagatgaagggtgtagcagtaaatggttttcagggggaatgagtgaacccaaagaacagtgatctgggacaaagttcctctgagctctggggtcagtggccagaaggtgaaggacagaactttactgtgaacaaaggttgttttattattcagataaagcctctcaggtactctctctgagctgcccttggaggaatacatgaaaagtctgtcagggcaaggtgaggactcctagtttcttctcttgtggttaatctttcctggttatttcatgagattcctagggagggagttttaagacaattgcatttctattttattttattttattttattttattttattattttattttattttattttattttttgagatggagtcttgctctgtcacccaggctggagtgcagtggcacaatctcaactcactgcaacctctgcctcccgtgtttaagcaattctcctgcctcagcctcctgagtagctgggactataggtgcatgccaccacactcagctaattttttgtatttctaatagagatgaggttttgtcatgttggccaggctggtcttgaactcctggcctcaagtgatcctcctgcctcagcctcccaaagtgctaggattacaggcgttagccaccgtgcccagcaattcttttggaaagaatctttcttagtcagctgaggaaattccatagagagtccctgctagtgcttcaggaaagtaagaggatgggggtgaggtgtaggtaagggtgaggagaggtcagagagagataccttgaggctgcttctttagttcagcatgtcaaagtgccatattttggggtattgttttctgagccccagcagcatcaaaggtcatagttcctgaaactgcagagacagcactgaagacttccatgtaggaaacaggatgtctctaaagtgcaaagagccaggacttggatctagaagtgagtagtagaatgggaaagaatctagtcgtaacttagaaaccacctcagtccttcctgggttagcatttgtcatcgtttacttaggctgctgctgaagggatttgattcaagcctctgtgactcagcagtgggcacaagcattgctatcccccttttttctaggaaaattgttcaaaagaaaaccttgacacgaactacgcattaaccctatattacaacatcttcatagagtcaggtgagaagaagggaggccagaggatccagtcttgaatgctaacggtatcttaaacagggtctttattgagttctaccttagtatggtaaattatagttgtaaggagaatggtctcccctttgtcccttttgactacaagaagccggtgctcaccctctgaaaagtcagaagatgtataacatctgctactcctaccaaatgctaagccactatgaggatatgatgctttatttttatttatttatttatttagagacagagtctcactctgtcacccaggctggaatgcagtggtgcaatcatggctcactgcagcctcaaactcctgggcacaagtgatcctcctgcctcagcctcccaagtagctgggattataggcatgagccaccaggctcagcaatgcttatgtttttttgtgcgtgtgtgagacagagtcacccaggctgaagtgtagtggcacaatctcagctcactgcaacctctgcctcccgggttcaagcaattctcctgcctcagcctcccaagtagctgggactacaggcacaaaacaccacgcccagctaatttttgtatttttttagtagagacgggatttcaccatattggctggtcttgaacttctgacctcgtgatccacctgccttggcctcccaaagtgctgggattacaggcgtaagccaccgtgcccagccaacaatgctttatttcttgactctctttctacacccctactgcaaaagactaattttccccaaagaggacctgattttgactgaattttagcctcttcctcttccacatgataaagctgctaattgcctgagagaagactgctgagttacagtgtagagggaagcatactcagggacaattagcaacaattctgtttctgttaaaccttataattcttatatcactactgcacagaactagacatggagctagtttatgtctcactgtaccatttactaattttttgaccctgatgaagtaacttaacctcttgtagctttatctcatgtacaaaattgagacaacagtaagatgttctcatctaagtaaaatgttgaaatgttggagtgttccaggcttgtttagatagatggaaaacacacacacactcattcactctctctctctgttactctgtctttccaataagtcttgttttcacttcttaagaatcagcctagaggtgactggaggaagagaaactaagttgtggtgacaaagaacaagactatgagtaaggatcactattacccttacagactggataaaaccctaagaaacaaaatcattgtgcaaaacctttcaggccaggcacagctgctcatacttgtaatcccagcactttgggaggccaaggtgggaggatcacttgagcccaagaattcaatgccagcctgggcaacataagaagaccttgactctacaaaaaatataaaaattacccaagcctggtagtgcatgcctgtagtcccagccactcaggaggtgggacgatcgcttgagcacgggaggtcaagcctgcagcgagccatgatcatgccactgcactccagcctgagagacaaagcaagaccctgtctcaaaaaaattttttttcaaggaatagaaccactgcacatgctcctcctgatcccccaaagtgtaagattttcctgcaaatagctatctcccaggacttacattagtaaggtatctggatataaaaatcagtgttccctaaatcagctgtgtttccattatatcaaaaataaacttttagaaattaccatttgaattaacaaagatacacacacacacacgcacacacctagaaagaaatcccgtaagatttgtgcagggcatttatgaagaaaactgtgcaatttatgggaagttattaagaaagaccacataatttaatagatacattaagtttatggtttagaagactcaatgtcattaagtacaaattttcttcaaatttgtttacatattcaatgtaaatctaaatcccaacaaatactaagaaagctgacaacttgattcaatgtgtacattaatgagcaaaaatccaagaataactatgaaaatcctgagatgattaaggagatgtgcactaccatatataaggatgtattataaagctataatattaagacaatgtggtattgagacaaagataagcaaattgctggtcaaatagcctaagctctaaaaacacatatatatgaaactttgtgatagaattgtcagttcatatcaaaaacaggatgattaggtcttttaaatggtactgacacaactgcttatacacaagggaaaaaaaagaaattagatacctgcttcacatcacctacagacatggacttaagacttaattgtaaaaggcaaaactttaatacttttagaagaaaatactttggaatcagcaaagatttcataagcaagacaaaaatactaatcataaaataaaatactgacaaattaaacctcatcaaaattaagaacttttgtacatgaaaagacaacataaagaaagtcaggaaatgagttgccaatcagaaaaaaataatttcaacagaagtaagccatgagggtttgtatcagactaaatttttaaacctttataaaccaataagagatagacaaaagtgcacactatgaacaaaataaaagccacaaacagatatttcatggaagaaactgcataaatggtaaattaacatatgaaaaaggactcaacctcatcagtaatcagggaaatctaaattaagtctaccatagagtactattttataactacaaaaatggaaatggggactaagaagtcttcttacattatataaaccaaaaataaaattgtaagaccccccaagcatcttaatggacccctcctcttggccaagggcattccaaagtgaacctgaaaaactagttaaggccatgatgggaagggggagctgaacatgcctcatcataccctcctcccttttggaattactggtagaacagactctaagtctgataaaaaaaataaaaaataaaaaacatttacaatctattctctctgaagtctgctgcctggatacctggaggcttcatctgaatgacaaaaccttggtctccacaaccccttatcacaagccagatcttcctttctattgataataacgaattgccaatcagaaaatctttgaatctgcctatgacttggaagccaccccacccctgcctgctgcttccagttgtcctgcctttccaaactgaaccaatgtacattttacatgtattgattgatgtcttatgtctctgtaaaatgcataaaaccaagctgcatcctgaccaccttgagtacatgttctcaggatctcctgagggctgtgtcacaggccattggtcactcatatttggctcaggataaatctcttcaaatatttcacagagtttgacttttttgttgacaaatactaagtgttgacaagggatttagtgacatagaaatccttatatcctattaatgacagggcaaagtagtatagccatgtagaaattaacttggcatcatcttataaaattaaaaatttacacatctataacaccttatttttctttcggtaccttttaaagatgttgttgctacattgtcttctcacttgcattatttccaacaagaaatctggtgttttctttgtgcctctgtgtgtagcatgtctttttatctccgatcacttttgagattttctctcactaactttcagtaatttgattattaaatccttatgctgttttcttcatggtttttgttgtttggggggtgtttttatttgtttttgtgcttggggttcattgagaatcttggatttataaatttatagtgtaggggagaaaaaataatttttcttctacccttctgagttctcagctgggacttttataacaagacagattaacaagagaaaagcagataatcagggaaaaatgagtaactctcaaagaggtggcctagaattttggcttatgtagcatcttcaactaaaagaaagaaagaagggtgttgggaaaacaagctatgggaaagcgttcaggaaaatcaaacaagagtaaggtttattatgcagatttaaattggtgccttctccattggtaagagccttttgtgatttagtcctccttcttttcccagcccagagagggagatagccttagaaatggagatttcttttaaaaatgtaaatttcccttacagaagggtaacttctactgtgtttttagaattctcctgtgtctactgtttctcaaaataatcagctcaaaataatccttatgccaaaaagtcatattttagggtggcacatgcctgtctcctacaagttttcatcaagtttgaaaactttttggtcattctttgttcaaatattttttctatctgttaccaggaaggggtcccaatccagactgcgagagggttcttggatctcatgcaaggaagaagttggagtgagtccatagagtaaagtgaaagcaagtttatttaagaaagtaaagaaataaagaatgactactccataggcagaccagccccgagggttactggttggctatttttgtggttatttcttgattatatgctaaacaaggggtggattattattcctttccaggaaagggggggggcaattccaggaactgacagttcctcctctttttagaccatatagtgtaatttcctgacgttgccatggcacttgtaaactgtcatggtgctggtgggagtgtcttttaacatgctaatggattataattagcatataatgagcagtgaggacgatcaaaggtcactttcatcaccatcttggttttagtggcttttggccagcttctttaccatatccttttatcagcaaggtctttgtgacctgttccttgtgctgacctcctatctcatcctgtgactaagaatgccttaacctcctgggaatgcagcccagtaggtctcagccttatttcacccagcccctattcaagatggagttgctctggttcaaacgcctctgacatatccaccttcctcttttttcaaggactccaattgtaacgctaaagatttttgccttagccagaccaaagaattggtgtggcggctgcccgtggcgatggaaacacggaccaagagaaaaaaggctgtaggctttattgagcagagtgacagtacaaagcttttcagcgtggaaggggtttcgagcgggtagtcagaggtcgatgatgcagttgcttttgaaactctttaaggcgggaaatacgtgtagagggaagatgttaccagagcgagaaacaaaggcagtaaattattttgtgacatgtcttagattttgaggaaaaccagaattgtaacttaggttttatttattttatgaccttgcagcagcatggcaaaggaaacaatcttacaggactttataaagtatgtttacaaggaattggaattgggagtatagataaagttcgctggtcatagaaaaacaggcatttaatattccttttagttttaggggagggggaagggagagagggagagaggacacagggaagcttacagcaaaatttttgctgtttatagctttttttgggaagaaaacacatgcacaaatcctggtgttaggaatattttaagcatatatctttaatattattcattcaggaccgaagtaagttctgatgcagaaaatgagtgagttttacagctttctgagcccctgtttgactcaggaagcccagctggccccctcctttcaaaattacacatatattaggccacttgaagttgtcccacacctcactgatgctcttttcattttttttttaaccctctgtttcattttggattgtttctattgctctgtctttgcattcattaatcttgttttctgtggtctaatgtgctctcaatcccatccagcatactggtattcatctctagaagttggattttagtgtttttctattttccatgtcttaattgaggtaagacccttctgggttctctatcacatgccttgtgaattgtgctctccttttttgggaactggcactatttccagccctgtgtgactgttgggtactgttctagctaatgctttcaagtggttctttcctggggtagttttttcacacacgtgcacctgtgaaattaaaaaaaaaaagaagaagaaactttttatctgaggaatgtgagcccctttaaattatcaggctcagagaggcattggaatgaaactgcagtcacatcactcccccttgagtgattatcttgtaaagccacttgctatacgggctccagactaactgatgccaagcagccataaaataacatatgctggacaccacgactcatatcctatagttcaacagtgtataaccaataactaatccatgtcatctctgtaagccaatgaaaatttctatcaaagaactttgtatccatccacttcttcttacctttgcctttaaaaacctgcttgtaacaaaagctgattgagcactccctgagttaacttggaagtgtgtcctgggcagctgtgctcactttggctcaagtaaactctttaaattatatcttgtgcttcagccccttccttctagatcagcacactgattactactctgctgaatacttggtggggaccctcagcagatctctggaattctctctgtgtgcagctttttcatttccatttcttggatccatgagctctagccaccttggtctctccagactcagctctgtctcctcaattctgggactccactgggacctgcctgagttcccctgtaccacagcctggagaccctctcaatgcagtagatgaggcaattgcagggctcatcttttttcttccctatctctcaggggtgactgtcttttgttgcctgatgtccacagtttcaaaaaaacattgtttcatgtattttgttcttttgtttaattttgtttagtttaattttgtttcaggtgagaggataaatccagtctctgctactccatctgggctggaaatctggtatatcattaataatattcttgttgttaatttgggttgtgggtttataaatgttcattttcttattttgcatcattaaccatatacacatatatattacacattttttcatttgcgtaaaatattagtcaacttttttaagttctaaaagaaagtgaagagccctggggcggaacaagggcaaagaagtaggaagagtctgtggccaacctcttaactcacgtacctttctgacccctctacctcttctacctagagccctccatctcagccagctccccctgtccttgtcaccatgactctgaaggtgcctttctgacacaccaagatggtcaaggaaaaatggtgctgggttaggtgacagggaagatcatgagctttcatactttatgatctgacaagccactgtagcctctcacatttatatactaagtgagggtctttcagaatagcgcttcagtgtctgcacctgactcacactattaggcagttaaaagctggggaatgagctcatgtgaagagtttttccatttcagatcatagctatttttaggaacacaagctacataaatgttttaacccttttcccatccttttcctcttgctgctgtgatacaggaaggaaatcaaaatggagtgaccttgctatctggggaaagatgaaaactgcatatgcaaaagcaaacagactgagatttataacgagttgatcccttaaaagcttaggaaagaatctcaagggcacataggaaaataagcaaagggcttgatagacataatcatgacaacacaagaaggtgaagtcgggaagaggaaatggacaaggtcatcccaaattgaaataacttataaaagataaattataatatctccagaaattaactgtaaacattcctataaaatcatagatgataattttttaaaataaaagattgagtagtaagaataactaagaataaaaaattaatgagttcctagtggaaacttaaaattgaaccactgggggactttctataatgaatggcagttgaagaaaaaaatcgggtaaactttatatgaatatttgagaaacacctcaagcattagcaactacataaaagttatacatttcacctgtccaagagctgttacaacagtatacaaaacatattaagcaaaattgtactatagacaattacttatatgcaattctttacttaaaatttagcagatacatttgaatagtttctaaaacacatgatcatcaaagaaggaattgagtaggaaataaagcattactgttttttactcataaagagatgaaaataaaataaattattggtcaattctttatgagatttaaattatcttagcatttatttgtttgtttttgagacagggtcttgctctgtcactcaggctacagtgcagtgacacaatcacagcgcactgcagccttaacctcccagactcaagcaatcctcctgcctcagcctcccaagtagctgggaccacaggcatgaactaccatgcccagctaattctttttatttttagtagagacaggatctcactatattacccaggtcagtttcaaattcctgggctcaagcaatccacacaccttggcctcccaaagtgttgggattacaggcatgagccactgcacccagcctatctcatcttttaaaaaaaacatatcaaataattgttcataaatcattttctatagtagagagcaatttttcttaaaattggcaaataagattttgcatctacctttgagaaaattgtatttgtaaagtgattttaaaagaatgaagcctatgagtatgatggcattataaaagtatcagtggccaggtgcagtggctcatgcctgtaatcccagcactttgggaggctgaggcaggcggatcacaaggtcaagagattgagaccatcttggccaacatggtaaaaccccgtctctactagagatacaaaaattaactgggcatggtggtgtgcacctgtgatcccagctactgggcaggctgaggcaggagaattgcttgaacctgggaggtggaggttgcagtgagccaagatcgtgccactgcactccagcctgggtgacagagcgagactccatctcaaaaaaaaaaaaaagtattaatgtatggaaatacaaatgtcatatatagatgtaaattctcctaattgttcttctgagcatcatgttttttttccatgaatttttattttaagttccagggtacatgtgcgggatgtgcagtttgattacataggtaaacgtgtgccatagtgatttgctgcacagatcaacccatcacctaggtattaagcaaagcatttattagctcttctacctgacattctccctcccccaaccccacccgactggccacagtatgtgttgttcccccaccatgtgtccgtgtcttctcatcgttcagctcccacttataagtgagaacagagcatcatgattttcattgtccatcaaatgctagaagactactctgcttttgttactatgtttgccccatttttctagctcttcttacatgaatttaaacctacatcaatggctatttcctcaacatttggaaacaacaatacttattagaaagaaagtattttatccttccaggctatagatcttacattcctcttacacaacaatcctaattccctcatgttatcctgatcaatgaaatgatttcacttatttttcaaagaagtagctattttactacaaagcaggaatcgcaaggcttggggtgggcactgttatactccatcagtgagtatgtaaaggaaatcaaactgtctgattttgaatcctgcttctattttttacaaccttggacaaattactgatttcctctttcactaggtttatcatttgtaaaatggagatactagtgtctactcatggattattgtgaggcttaaataagaaaacatgtatcaagcatatttgtctggcatgtaataagcactctaaaatttatgcagcgatgaggataatgatcctagacaatctgatagcatcttatccaaaggaaaaaatgcgcatttcctttgagtaagcactactgattctaggaatgtgtcctaaggaaaaaataagtcaaatgtttaaaggtagtcacaagactattttggtagtaagcagtcttttttactggtcacacagtaaaaaattagaaataacctacatgttcatgaagagaagttggtgaaataaattatggtacatgcatacagtagaaaactttggagacaaaatagtaaaatagttacagatataggctttgaatataaattttaacaagctgaggcttctctcgtctcttcagaacaccctgagttcttcccggcctttcttccttgcttttcatttgtgtcagtcagctcttgcttgtacagcaatcttcaaatctcagtagcatataaaggtaagcatttagttctcacttacaagtttgcagggcaggtgaggcagctctgcctcaagccacaatgtctaggacagctctgtttcgcacggtggctgactagctaaaaaatgttcttgtctcagcaatcacaggagaacaagagggtgagagataatgtgtgaagcttcctaagtgctaagtttgaaattagcaccatgtcatttccattcacatttcgctggccaatgaaagtctcatgatgagccacagtcaagagtcagagacgtaccctcatgaggctgtggagagagtgtagattcagggagcggtgagaaactggggccagtacaccaatctacagcatgatttgtcatcatttttcattctctgctagtaagattgccaaagtctctctgcactcattgaattcatcctagtttccatttagctctctttctctcttaccacaatacctaaaaatctttttatggggttacaactctgtctcaggagccacctcagtttggtggcacagagctccccacttgtactctgaaactcttttcttgaagatattgttatccatgtgcatgagttatttttcttctccatagcatccacattaaacaattaattaccttggatttagccaaaataaacactccaaattcatgatgtctttcaggaagagagtttgttttcttttttaaccaaaatgggagattgatcctgtctgtgtcccctagaggagcagaggctggtttgtattagggcagctcttgtagatgagtaacttttcccatggcctcatagaggctgatatagatacttctggattcaaatgattgtttggaggcattagccaggcattgaaccaattataaagagtgaggttttgccatattctaaccgtaagaaacagaaacggtagagggtaaaaatagaatagaatgtcaacacaactttagccttttccctggattctgagagttcataacctgaaaatcagagattcaaactgggagagatgggctaacaggtatgagcatgggaaaagcatgtttcaaggatttgagatgtatttcccagaaaaggaacatgatgaaaatggtcagaaaaggcaatttccttcctcttttctaatttggctctggagccaccagcagaacctcttcaatatcttgcatgttacagatttcactgctcccaccagcttggagacaacatgtggttcttgacaactctgctcctttggggtaagttggactcagaggggacagttagaagggtacaggctgtggctgttgtgagtcaagagttttgtcttcctgtggtaactctgggtagaactcatgagtatgaagcaacttgtatctgtgcttccacggtttattagagcttattttatgaaaaggatgggaagggcaaccctgaggtagcattaagcctggacgcaccgcagtgaagtttccttgataaccacctgtagcttgttcagttctgttagtactggattttgagaaagagaaatagaaactcaagagatctgagttgatccctcagagtctacattaattctgtctccccaattctctcttcctcattattttccttggaccaactgatatctttattctctgatctcttgcagttccagttgatgggcaagtgggtgagtgatctctaactcagcttctccttctatgccactttcctacttccaaaggatgggtcctattaacctgcagaagagcatatagggaaagcagagaaagaagaaagatttataaattatgtaaaatctcccatattcagagcatgattttcataaaaactatgatttgtaagctttctttctaaagttttctgaatgagctctttcctctgagcgaaatgcctgaatgtatatataacagcaggaaagggccagaattgcacaaacactaaagtagtctgctgacactgaagtagtctgctgggtttcccaacatcccctaaaccagtcccctttacaagaaagcagagtgggttttttctcctcagaaagagccaggcaaatactgaaggcttcaaagagaggagtttgaacctccgtttccaatgtacaagctgctgaagccctgcaatgtactctcagagacagtatagctcagaggataaggaaaacagctccgcttggcttgcccaagtctaaaaccctgcttcattgctcccaacagaaaaacctacatcagtaatttaatcctcaggagccccagattcccaacacccagatgaggatttaataacaatgaacagaggtctctgcagcaggaggacactcttaaaggctggcttttgtaggtttccacttgcctatttttcaaataaatctaaatatgtatttttcccttgtgctatccacaaaagcctcaccagttgctcagagccctcccctttactccacttgatctttttctttttcttcttgtaatctccaagtagacaccacaaaggcagtgatcactttgcagcctccatgggtcagcgtgttccaagaggaaaccgtaaccttgcactgtgaggtgctccatctgcctgggagcagctccacacagtggtttctcaatggcacagccactcagacctcgacccccagctacagaatcacctctgccagtgtcaatgacagtggtgaatacaggtgccagagaggtctctcagggcgaagtgaccccatacagctggaaatccacagaggtaattatgacttggaccaggagggccggaaactacaaggtcttcctctgcgttctctcctttctggatgccagatgtgtgtgtgtcgatttatctgggtgcaggtctcagcactacgtacctaccaggtgacactaaatcagtatactcaaaacatcacagcagggtccttaaactgtgtaccaacagtacctcagctgggccagctctaagtaggatgtctagagtaagacttcggccctaagattgtatcattattccaaatgtatgcctgtacatagtaaataataataattcaaacaaatgagcaataatgaacaatgaaatatcttcctcccacccaaaaccctagatctgcagtcaccttccacagaaacaaaactgctaatatatatatatacatattatgcatatatatgtatatattagcattattatatataaactatatatatatatatatatatatatatatatatatatatatatacacacatatatatagttttaaagctgtgggtggtagaacactttctaagtattgtcctatatcttacttttatcacttaaaataccttgaagttctgtttatattaatagaaatccactttaaaatgtctgctgcacagctgtaccagaattaatttaaccattctgcctattagcaaatttataagatgtttccactcttttgattttacaagcattgctgcaataattatctttatacatacattccgggggcacatttcatagggtatctgtaagataatattctggacatggaattattgtcatattttaataagtggaagcagaaaagcccaccacccacttaaacctgtaaggagtttctattcatcaagagatggagactgcaatattcttcagggaaaaatgcttcattcaatatgcaagacaaaataaccaaatgtattatttagttattcagaagtgatgagtttaaacttctttaaaaatgataatgcaaaagttaatccacactggaggcaaaattgcctttatgcagacatggttgctgttagaggaaatgtgttttagccaaggaaatgttgagaatgtctgagggaaggcttgatgttcctcatgtgtcccttaggtctctgtaaataagttcttaggatggagaggttagggaagctgacagagctgtttccctttttttttttttttttttttttttttttttgagacagagtctcactccgttgcccaggctggaatgcagtggtgcgatcttggctcactgcaacctctgacagagctgtttcaacaagacactttgggtaattcaagcagaagtgtttcatggttcaagtgacaacaaaaggactagggctgggaagagcccattttctttacctctacacagactctaggacactcagcatcagtgacttactgagaatcatatcttttttacattacattttaatgtgaattttcattgaaatataacttatgtacaacaagccataaatgtacgccacagtaaattttttcaaagtaaacagcatccagatctattttagacatttccagcacctcagaaactccttcttgcccatttctagtccacccctgacactgacttccagcaccataggttttttgcctatttttgaacttcatataaagggctacggtatgggacaggatgtactcttttgtgtctggtttatttttctcaacattatgattgtgaacagtatacatgttgtaaattgaagttcatttgttcttattactgtatatttcatattttcccattctgctgaggggctcgggttgcttctggttttgaccacttacaaatagtaatgctgtggatatttttgtttacatgtttcaaatattttctaccattactaatgttcgacagtatctgatggaggtatgttacaatttcccactcttttggatatacaaatgcaaattaagcatttccctaatgactatgatattgaccatttttcacgtttattacctatttgggtatccttttttgtaagctctttttgataatttttctattgtctgtctttttcttactgacttataggagttatttatatattctggatataagtcctttttcaagtgtcttaaatatcttctcccactctgtggcttttcttttcactataatattaaagttttgtttgttttcaatgaacaagacttgttaattttactacagtacaatacaccaacatttttggttggtgctgtctatgccctattttaaaatgttttgccacagtcagccatggggaattcaattgcagctcactgactcttagtcatttcaatttaatcagtatatgctaagaccaagaaaatgcagctggttggtggacccgagccctaatcatatggctgacaccaaagtcatgaaggtaggggaatgattgttgagtaggaaattagtaatgtctgctaaaagctgcatctcgtgagttttgatatataatactaccattaccatttaagtttaaaactcataaatttctgttatacattattttattcatgaattacttagatgttttttggagggtagttttttgttattgatttctaatgttatagcactttggttagaatttgtgttaaacatggtatcagttcattagtatttgttgaaaattgctttgtggcctagttcacacttaatttttctaatattgcatgtgtgtttgaaaagcatatgaattttctttctaaagtagagcatccacaaaatcaagcctattaattgtgtcattcagatattttctaccattactagtgtttgacagtttctgatggagatgtgacagcatttcccactcttttggatatataaagcaaagatggcagtgtttggacagtgcagtctttcagcatctgctggctgtgggtgggaataagggagggaagagaattaattctatttggaagcattatatcagtatccatgactgtaaaattcatgctatgtatagcatagaaacacctgccttccattcttagataagttctggaggggaaaaaggcactattgtctcttttccgccttagtctcctaagaaccccatttttacttagccaaaccaactgcctctggagaaaagaaaagtagttgaagcatttttggttatgtgtagaggtgtttgtcgaaaggaaaaacccattgacttggagcttgttttgctagtgatatcattgatcttacatatgtgagtattcatatcaatgtagtaggatgtttatatctggatgtttgcccttctgtgtgtttgtctcaggatgcgtggtcctattaacaaatttgtcaagagttggagtgtatttgttttctattgctgtgtaacaaatttagcaacaacatacatttaagatcttccagtttccatgggtcaggactcccatcacagcttagctgagtgctctgctgagagtcttccaaggctgcagttagggtgttgactttgctgtgtttctgtttgcagctcttccaggctcacaaggtcactggcagaattcagttctttgtggttgtaggactgaggttcctgctttcttgctgcccatcagtggggggccactctcagctcctagaggcccttgccttgtggcactcttgtaggccctctcctggcgtggcagcttacctcttcaagttcaggaggagactttccatccagactgctaagatagagtcttacataatgtagcaatcccaagagtgacatttcatcacccttgtcatattctgttggctagaagcaagtcataggttccacccacactcaaggggattatgcaagggagtgagtcattgggatcattttagaattctgcctaccatgctgtatgaactgtttttgtttcaaccaacttctgagatctggaaagggaagataagaaagggctgtgtacgcagttgccagtaaagattgcttttctttccaccaaagctaaagatatttgaggaactggatataggcctgagatttagcagagctctgaggctggatgttgcaaggagaaaaaataggaagcccacagggccaagcttgggcctccttgtacctcctccactgtatacatacattttgggttcatatttttcaggctggccactactgcaggtctccagcagagtcttcacggaaggagaacctctggccttgaggtgtcatgcgtggaaggataagctggtgtacaatgtgctttactatcgaaatggcaaagcctttaagtttttccactggaattctaacctcaccattctgaaaaccaacataagtcacaatggcacctaccattgctcaggcaagggaaagcatcactacacatcagcaggaatatcacaatacactgtgaaaggtattgtattggaatagtcatagaactgatagtccctccccctgagggaccatcataaatattctaaactcctcactttaatttacaagtgaagaaaccgggctccagagaggtaaactgcattactaaaggccacaccatgaccagtagctggaaccagaactgaggtctctgggtcctagtccaatactctttccagtgtaccgcaagccccatcaataatcacaggagctaatgtcaatgtcagggcataatggtgatccatttcatccatcattattttagttgtaaagaatacagactcactctaggtagataggagagttagaaaataataccatggaatctcatggaagccccatagaaagagaaacctggaaaatatgaggaacgggctatactgtccatctacctctcagggacaaagcagcctctgtggtgccacttcttcctgagcatctgcaggctaagcagtttgcatatggccttgttctgaccctttcacggcctttcctcttaatacaatcactagcaacctttctctgtctgagaaaaaaaaaagttcactcctgtgggaaagaaattattgtcccagattatcttttaaagtcaggaacaaaaataatgagtcactgaaatgtggcgggcacctgtagtcccagctactcgggaggctgaggcagaatagcatgaacccgggaagcggagcttgcagtgagccgagatagcgccactgcactccagcctgggcaacagagcgagactacgtctcaaataataataataataatgataataaagtcactgaaatggcaagtgtgtgagtcagggttcactcctagttgaccactgccaaaagggcatggttattgaccagatgacatggtcattcagggaaggatggaccatgtagggcaggggttcccaacccttactggtccgtggcctgttaggaactgggctgcacagcaggaggtgagcttcttcatgagccagcattacggcctgagctcctcctcctgtccaatcagtggcgacattagattctcatagaaacatgaatcctattgtgaattgtgcgtgcctgatgatctgaggtggaacagttaccttccaaaaccgtccccacttcaccccccggctgtggaaaagttgccttccacaaaatccatccctagtgccaaaaaggttggggaccactggtatagaggtatcctcagtaggactcagcaagctggcaaccctaattatgtctattaggacaccccaagaatggctctctgctggaagtaaaaacggttaatgccttatggattcattttctaaggccaggtttcccaagggggtaaagggcatgtcttttgtgaaaaggacctggatgctaaacaggcaaccctttcccccatcaactttctccttagagctatttccagctccagtgctgaatgcatctgtgacatccccactcctggggggaatctggtcaccctgagctgtgaaacaaagttgctcttgcagaggcctggtttgcagctttacttctccttctacatgggcagcaagaccctgcgaggcaggaacacatcctctgaatactaaatactaactgctagaagagaagactctgggttatactggtgcgaggctgccacagaggatggaaatgtccttaagcgcagccctgagttggagcttcaagtgcttggtgagtgagaatgacgggaagccactggcacagaagaagggactcccttatctcccatgggactgaggtttgttcaagggtttttggcccagacaggaggggaaagtctcttcaggaaaagcccacaagcaggcctttccatccttgattcacaacatcactcttctcctcgcaaactgttaaatttcctttcctttctttttctttttcctttgcctttccttcctccatttctttccttcattttctcctctgtccttcttttcttctccttcattttattttcccctccctcccactcttccctccactccatgacccccgcttctctctctctctctccctgcttccctgcctccctcctcctcaccaacaatctcaccaacaatttatcaagttcttcctatctgttgtcatacgtctggggatataaagacatttgagtatagttcttgcttcaaggagctcacaaggtggatttatcagacagtgattttgtaaactgcaaatcaccacctccccaagtatctctatttaactgaggcagagggattgtgagctccagaacaaagtctccttgggggggaaaaaagttcatcttcaacccaaattcatttcaagtattaaatggcacagagatatcagttgtctctggaactaggaagtaagtccactgacagggcccagcaattaagctcttccaaggagcctgtccctgtctatacaccatatagccagttagagctaccgccagttccttcctgctccctgaaatgaccagtgcctccctgaggacaggcacatcaggtctcagccaaccttcccttccaaacataactcagccagacccctctggtctctaaatagtatctcttctctttgtctttttctgtttcaggcctccagttaccaactcctgtctggtttcatgtccttttctatctggcagtgggaataatgtttttagtgaacactgttctctgggtgacaatacgtaaagaactgaaaagaaagaaaaagtggaatttagaaatctctttggattctggtcatgagaagaaggtaatttccagccttcaagaagacagacatttagaagaagagctgaaatgtcaggaacaaaaagaagaacagctgcaggaaggggtgcaccggaaggagccccagggggccacgtagcagcggctcagtgggtggccatcgatctggaccgtcccctgtccacttgctccccgtgagcactgcgtacaaacatccaaaagttcaacaacaccagtctaaccagaactgtgtgtctcatggtatataactcttaaagcaaataaatgaactgacttcaactgggatacatttggaaatgtggtcatcaaagatgacttgaaatgaggcctactctaaagaattcttgaaaaacttacaagtcaagcctagcctgataatcctattacatagtttgaaaaatagtattttatttctcagaacaaggtaaaaaggtgagtgggtgcatatgtacagaagattaagacagagaaacagacagaaagagacacacacacagtcaggagtgggtagatttcagggagacaagagggaatagtatagacaataaggaaggaaatagtacttacaaatgactcctaagggactgtgagactgagagggctcacgcctctgtgttcaggatacttagttcatggcttttctctttgactttactaaaagagaatgtctccatacgcgttctaggcatacaagggggtaactcatgatgagaaatggatgtgttattcttgccctctcttttgaggctctctcataacccctctatttctagagacaacaaaaatgctgccagtcctaggcccctgccctgtaggaaggcagaatgtaactgttctttttgtttaacgattaagtccaaatctccaagtgcggcactgcaaagagacgcttcaagtggggagaagcggcgataccatagagtccagatcttgcctccagagatttgctttaccttcctgattttctggttactaattagcttcaggatacgctgctctcatacttgggctgtagtttggagacaaaatattttcctgccactgtgtaacagctgaggtaaaaactgaactatgtaaatgactctactaaaagtttagggaaaaaaaacaggaggagtatgacacacacagcaacttgattctagattatttggtttgatccgtaaatgatgggatggggcgtcgcgctccgagcgtgtcccacggcgggcccctggcaccacactgtggccgcatgtgcatattgcagcctccgcccgtatctgggggccgcagccgccagcgcccggggacccagctgcggcgaaagctgtcgggcgcgcgcttcgccgcagctccgcgcccccgccaaaacccagtgagaaattatttgcattcctggagcctgcaggagcgagaaatgagctgtaggagtcggtgggcagcaacggcggcaggcggatggaagagagcaaggggtcgccgttcgtgtcccattcgcccgagtcaaggggcggccccccaaaatcccaacgtcattgtttcctcggggccggcaggtgtgaaaacccggcggcagaatggaagttcggtagtctgcgagggcccgcggcctccccaggcgcgtagctgagtccctccaaccccgccccgggcccgcctgctcccgggccccggcgcggcgccacctggcggccgtctgtggaggttgcagctgccgccaagccacggggatgctgccggcctcaggtgcccccggccgagcctccgcggagaggaggactggtagatcacaggaaacgggaggacggcgctgggctcccagcaggcgccccagcttcttggcttgtcgcaagagcagccggaggcggcggcggcagggagggagcgggtggggagtgggagaggccgcccgcctccccgtccagctcggaggacctcccagctggttccctcaccgtcaaaagcaggaagggagctggctcggcgggatcagcaagccagcgggcaagaaggctccaggctccgcaggggccaccccacatggactcgggaaccgccgagcttcacccacaagggcccacggcccatcctatcacggatgaaaagattacaggactgacaatgagcccctggagggatctgatgcagctggcggggagaaaggtgggtcggacttagaggggtggtggggtggaggaatatctttcttctccctgggacctaccgaggcttcacctgtgagggtcttgggcccatccttcaatccgagagcttccaagccaaagcacagctccccagagtggacaagtggagcagaaccggcattaggttgggagggtgggtcgttagggttagttcttcaccttccaggctgggtatggagacctctaaattcatcctagggccacaagagcttctgtaagagttcaggcccgtttcagaacactcagaggttcctagcctgagaagtaatccccaaagcagaccaaccggtttggggtaaaacaggaatagttgggtccattctggatctttcctagctaaatgccttcaggatttaggaacattttcctaggagggccaaggattagctagacctgcccagcgattccagccctgagaaccagacagaatggaggtatagctgacagctggctgggagggggctgacggtcctcactgccaccaggcttagttggagacagattccccgggctgtagagagacaacagtagaagcaaagagaccagttaggagtctaggtgagaggcagcggcagcctggactaacatggtaacagtggagctattgagagtggtcacatttggaagatgttttgtaggaagtgtcaacaaagtttcttattgattagatgtagggaatgtgagaaagagaaggggggggaacacgtagattttgggtcaaagcaataaatattccattgacagaattgaaacagcaagttggtggaggaggggaacggggtagcaagaagcgaatgtttcatattggacattttaagattcctatttgacatttaagtgtaactcttgaaaaagcaatggatatatgaagaatcctagactagagatacaaatttgccaatcatcatatagatgtggtatttagagtcaggggactagaaagaacaatgtaagggggaagtacagatagaaaaaggtctaaggctgagccatgaaatatgccacattttagaggttgcgtagaagaggtggtagcaaaggatattgataaggagtaccagtgaggtaggagggaaaacagagaataaaacgtctcaagaaagagagatcaactatgtcaaattctcctgagaaaactattggatttggagtgggaatgcactaaatctgtcgatctttttggggcaggggcgggagggagagggttagggaggattgatatcattccaacactgactttccaatccataaacaaggtataactctcatttatttatgtcactgttaatgtctcacaacaatattataatattctctctagatgtgttagatgtattcttaggtccttcatttttgtgttattgtaaatggtattgtcagaatcttcagaagtaattattggccaggtgcggtggttcatgtctgtaatcctagcactttgggaggccaaggtaggcagacacttgagccaggtgttggagaccagcctgggcaacatggcaaacctcatctttataaaaaatacaaaaattagccagtggcacacgcctgtagccccagctactcaggaggctgaagtaggaggatcaattgagcccaggaggcagaggctgcagtaagccaagatcgcaccactgcacttcagcctgggtggcagagggaaaccctgtctcaaaaataaataaataaataaataaataaataaataaataaataaatgaatgaatgattattaccagtctcacagctgaggcagaaatttaaaacaaataaataataagtactgcatttattcactccaagaaaagtaaaagctaaggcccagaatgtggcaaggcaagggttaaaaagaagagaacaagttttcctctgcctagcaagcttacttcaaggacagttataagataacgctgtccaaatagccaaggtcaaaggaataggctccagacacccctcccttccagagcaaggttggaggaagaaaaagagaaagattcttttactcttactctttccccaggcctcttaagcattatttacaaatgtctgtatttagccagtttttgtttttctttcgatgcaactacaaggtcaccagctatgcaaggtcacaagttatgttatgctatagattatgtgacctgtcactgtatgattaactgcttttgttttgtgtctgtaaggccgcttataaaaaccccactctgtctttgttcagtgctcagctttttagatgcaaacctgctgagccgtgtgtacctaaaataaacaacaatcctcctgtttttccatattggcctctcctttcctcagtttaccacaacatagccataatagtataaaaactgaaagaccctaagacacatatacattaagcttggcaacggaaagcaggatgtcacacacacacaaagctagtaatgtgaaaatctggtcttgcataaggtcttttaggtacagacttctttgttaatgcacattggcaggaaaatgggaacgaataaaattgcttgctgtccttctccctttattctccacttcttgttttttctaaatgtggggtcaaaacttccatgagggtaagaagttcagttttctgcctttccccttcatctccctatcacacatgtatactactccttaacacttagagaagataaaaaaagaataaattgtggagagggagcatatgtgaaagtaaaagattcccagacataatacgggagttaatggagaaagaaaatctctaaggaagactagaaataattgggttagggattctcgagaagtaaattaaattccccaaatatggtattctctgagaagataattttgaagaagcaatggcgtgatatccagtgaaacagcagtcctctggagcctggctgtgacttcaaggcccagttcttctggaagggcagaaaaatactttgaagaggagaaatgggcatttatataggtttataagtaccatctttattttagaaaataatcattttctacctggaattctagtttattgtgaccaaagattgtaaaatttcaggatatggctgaattaaaatcttggtcctgcacttaaatagctccttgaattgcaatttcttatcccaattattttatcctttcattccactgtgaaatctatatcatggcacttaatagtcaactttattattttaatttaacaaatgcttatttacctttcatgggttatttcatttagccttcataatatctcttgtcattgcctcacactcagtcggtggcttttaatactattctattattttgatcaatttgtataatatattctctcctcagtgtttggtaaagctgtctgggcttgcttttgtttgttttttgagacagagtttcgttgtgtcacccaggctggagtgcggtggcatgatctcagctaactgcaacctccacctcccaggttcaagtgattctcctgcctcagcctcccaagtagctggaatcataggcacacgccaccacacccggctaatttttgtatttttagtagagacaaggtttcaccatcttggctaggctggtctcaaactcttgacttcaaataattcacccacctcgccctcccaaagtgctgggattacaggcatgagctgccgcacccggccttggtgctatttttaaggatatgtatatctgatttttttttctgtttctcttatagttaattctttagtcaggtattttacttttcttagctcaactttggtaatttgtatggaaaagtcaacattttgtctacatttgcaaatatatatcaaaaatacacatcattttaatatcttctatatctagtattacttatgtgctttttcaatagtaagtttacggaaggattaactcttaattttcttttcagggaacacagtgtttggttttataaattccattttggtggaataggaaggtatgatctgtttcattgactatgctttcatcttactttatgccttctactttccacaggtttttgttgtgttcctttgttagcgttggagttaaaagcttaattctctctctgttgctcaggctggagtgcagtggcatgatctcaactcactgtaaccctccacctcccaggctcaacgatcctcctgcctcggcctccctagcagctggaactataggcgtgcaccacgatatccagctaatttttgtatttgttggagacacagggtcctgccatattgtccaggctggtctccaattccagaggcaataattgggaggccaagacgatctgcctaccaattattttctcttaaatgcattttaaagctacaaattttctcctgactgcttcatgtaggttttaatattatttgccatgaaatatatttcacagtggaatgacagataattgggataagaaatggcaattcaaggagttatttaaatatagggctaagatttgaattctagcttactgggaccaaagcttgtgaagtctcagggtatggctgaattatagtgctcttgttatttctaaagagcgtataatttttattctgatatcccctttaacccatgtgctttttcctaagagtacaacttaaggagggcatgtttgattattttattgttttataatcagttaactatgccctggtcctatatggtttcagcttttcagcacttgttgaggcttaatttgccatctcacttatggccaatttttgtcaatattctatgtgaatttgaaaataatgtaactttcctattttgaatataagatggtataggcataattatagttatgattaatcttattaaccgtgttcttcaaattctccatatcctcaataagtttcagtcaactagatctgtcaattcctaagaaaggtatattaaacttatcactgtgattgttgacttatatgcacatatgtgtatgtatccttgttaaatgcaaacaattcatggtcattccttaatggagcactacctttatgaatatgatatacccttctagtgccatatataaatgtatttttaaaccgacttaaaaaaaaaaaaaaaagaggaacttgctctgtcaccaggccagagtgcaaaggtgcaatcatagctcactgcagcctcgacctcccaggctcaagcaatcctcctgcttcagcctcctaagtaactgggactacaggtgcatgtaaccatgcctggctaatatttttactttttgtagagacaagggtcttgctttgttgcccaggctgatctcgaactcttggcttcaagtgatcctcctgcctcagcttcccaaagtgccaggattacatgtgtgacccaccatgtaagcccacatttttctaacttctacagtaataatatctatatcctatttatttataacataaatcttacttagcttgttttacttctcttcactcttgctttccctaccacccttctacatcacctggaatttgaattccaggttttctttttaattttctagaatctaaattcactttgtttagcaatatcttttaccaaatacatgaccacctttgcttccattatctcacatcttcccttatgatctttttaaaattattgctggaatagaattctgaaaagtcacccacacttaaatgatagtttaattgaattcaaaattattttccctagattttaaaaaataatgcttcgtgtcttcttatatccagtggagcccaaatgagttggatgtaaatttgacttccatttcttcataagcattttccctgaatatgtttagaaatttctccttgttcccaaattttgtcactgtgaatctaggtgagggtccttctcatcctgtatgctcagaatttaataggaccttgcaatctaaggatgtatgtatgcatttagatcctgtgaaatatcctccttttattcctttattttctcatgactatggttgcatactacacaatagtaggttgtacactacacattggcaaatcttactattcaaatgacagcccctgaaattgtgcagtgcacaatcagcaaatcttatttggtagatctgtattttatttcttacttgttctcaattctcccctcctctctaactcctcatcctgttacatgagtttggaacatctggatctatttttcatatcatttaacttttctttcatctctgcatgcatctttttatatggctttgtggaggaatttctggcttatcttgatcatcatgaggagggagaaactcaaactatgtgtttcctgtgctttcacactacaacaatcaacacagaagactgacggcggagcggggttctccacacagcaagcaagcaatcagttctgcagtggacaccagctgagtgtactccaattcagtttttacactatttatcaggagatcccacaggttgaggactgagtctaccagactgcccccacttcaaatgccagttccaagtctgggcctccagaacttctgaccaaccatttccaagctggggttcccatggcttcctcctttgcattgtattaatttgctagagcagttcatgaaactcagagaaacacttgggtttactggtttataacaaaaaatacagatgaaaagatgcataaggcaaagtatgggggaaggagcatggagcttccatgcacctccactgggtgcgccacccttcaggaacctctacatgttcagctatccagaagctctccaagccctgtccttttgggtcgttatggaggctccattgcaaaggaatcactgattaaaccattggccattggtgatcggcttaaccttcagcccctctcccctccccggaagttggaggtgggctgaaagtcccaactctctaatcctccccttgttctttctggtcaccagcccccatcctgaagctacctaggggctgccagacatcagtcaactcattaataaacaaaacgacatcacactttggtgtttctaaggattttaggagttgtatgtcaggaaatggggttgaagaccaaatatatatttcataatagcacaatctttcagcttatttattttctcttggctttatctatcctgttctggatttatcccttgttgaatttttatgtcaataatcaaattttaaatttccaagatgtgggagcgcccagttacttggcacattttcctgcctccttgaaccaaatgaccgcactcactgctggggtcaaagatgtcagtcaccagccagacatggtggttcacacctgtaaacccagaactttgggaggccaaggtcggtggatcccttgagcccaggagtttgagactagcctgggcaaaatggtgaaaccccatctctacaaaaaatacaaaaattagctggttgtggtggtacctgcctgtggtcctgactactggggaggctgaggtgggaggagagcttgagcccaggaggttggggctgcagtgagttgagatcgtgccactgcactccagcatgggtacctgaactgtcatcctatcagttgccccaagaccaacttttgtctcctggttccaaaacatgtggatcattttttggtccactcctgtcttctgcagaagtcctccttggcactcttcactgttaccccatctgccatctttgtcaattttttatcatttctaggaatttggggtggaatatgagaagaaagcaacatatcttcaggacacaatcttgaatcagtagctatttttcacctgtgcattagagacgggaaacttgcagagcacttaacaggacttccctacgatcaccaactagtatttattgaattgtttattagtaggaaacattaagcaattatccttcataaaaacattatgaagtaagtaagcattactatagtcccagttttaagatgagaaaacacagattaaaaacatcctaaagagcagagccaagttacactccaggtggtccgtctcagaagcctgaactctttactaatacactatacgatggcatatccgggtgattttgggaacacattatacttctaccctgccaggagggccaaatgtatttactttgtcatctctgtgctgtaaggggccacatttctacccatcaactcaatctacattactcaagcatgcttgtaattcatatgttatttcctcatgccaggaagaacagtcacagttctgtttcactatgcttttatctttgagactcaaattcccccctccccactataaattatttgcacatactagtctagaaaaatttaatatgccactttcccccacaaacacatctccacaatcataaacatcatgaaataaacttctcttagacaaatgaaaaagtttcttacctttttctccaggctaaggatcaaaattcaagttttacttggttaactctcctgctaatctgaaaactgtcttcttctctatagatgcttgctgtttcaggggggcaggcgggagttatttaagaataatttccattacctaataccttgatactaatgtgaaaaaaattatgaaaatcagaggtcaacacttaaaaagatccacgaaaaatctcctacaaagacacttaaataagtaaaatcatcaaattttcataatgtaacagggagaagattgaagaaaccaaaaaaagcaagtatgttcctttgctggaactaattctatggctaatatatatacaagttaatcagcatacctttctcctgctcattattctacatataatatgggtcttaagtaagtaaacattccaaactagatgaaatacagttccagagagaaattataagtagtttaagacttaaccctttgtattagtcagagttctccagagggacaaaactaataggggagacatatatctatagatatagatagatgataatagattagatatagatatattaaaaggagtttattaaggagaattggctcacatgattacaaggcaaagtcctacagtgggccgtctgcaagctgaggaagaaagaagccagtagtggttcagtctgagtccaaaagcctcaagagtaggaaagcccatagtgcagccttcagtctgtggcctaaggcccaaaagccccaggcaagccactggtgttaagtccaagagtccaaaggccaaagaacctggagtctgatgtccaaaggcaggaggaatggatggaggcatccagcacaggagagggatgaaagccagaactctgcaagccagcttagcccgcccaccttctctctcctgttttgttgtagctaccctggcagccgactggatggtgtcaacccccattgagggtgagtcttcctctcctagtccactgactcaaatgttaatctcctctggcaacaccctcacagacacacccagaaacaatacttagctatctaggcatcctttaatcctatcaagttgacacctaatattaaccatcacaccttaggatttagaattttcttaagaacactgaatgacccttgcccaggatcgtatctgtgctgtgtctgaagtcttagactccctcctggcctaaagaattttccttcaatgcaatgaaaaatgataatcccacaaactagaaaccaagacttgtgcaaaatcaaaacattgcaaaggtgggtgtggggaaatcaagctattatctttaggtatattctattcctaggtgtttaaaacactaatattaaaaagtgatatggagcttcacctaccctctggcaatttgcagttattgtcctttgatcatgtaaagcaactgagatcatttgctcctgacttcacttcactaatctatatccttcattttttgctccaagtgttccttcttctgagtgcctagtgctgctccagtacctagatatctctctctccccctctctttctgtctcaatatccaatcaatcccaagctgtattacctctttaccaactttgggaaagtggaccagtatccaggcttggataagccaaggaaaaatactaaggaactgcttaaagctctagtagttcttctactttgctgtttctggctttggccatctaaagcaaagttccttggattggttgacagtgagatagtctctagattcttgtgtctctttttagtagggccacctaagatgtatcatccattgtgtaatgagttcttgaccaaagaaaagaaatcttaaggtcttccgactctgtcatctttcttgtttgccactctttggactgtaatttgaagagaaaaaaccttgttttcttgtgaaaattttggatgctgagtagttgacaacaacagtaacttcagctagaaaatgctggaaacaatttaatacgcagaaatgattaactccgaaatcatcaacatgactccaccagccccatttttaaatttctatttaaacatttcccaaattatttgcacattcttcttttggctgtaagtcttgtttttctctatgctagctaatagttttctagataatttctattcccttgacttgttcttatgttaaatcctcaaaattaagagctttcaactcaaaaatcagaaataggaaagaagtgtttaatgaaatgatttcacttttttctgaaagtattgacatgaagtattaaaagcatcatctgatagaaaaagaaggtacttgccaaatgttatatcggcctttatagagcactagtaacagacactataaagtcttttgtttcctaatttattattttcctaatgggccacatagcagacactgaaggttctacgtaacaaaggtcctacaagtaaattgtgaaaatcccttattggatggtgtttttagaatacagaaggtcctatttccttaatgcaagatgcttagggaagtcactctcaagtcactagaaatctattaaagcaccacttgctggaaaatggaatgtgctctggaagtacaatggtgctcttgctagcgccttcctaaccataacaataataagaacactgatcaaatatttaccatgttccagccactgtactaagtgctttgggtacattacctcatttaatcttcatatcaagcctagaaggtagtttccattattttttccaccttacaggggaataacttgaggatcaatttgctgtaaggaagtttatttatcacaacaagtaaagaaagttttccaaggtcatacagtccttacgtggggaagctatactcaaagctgatgttcatcgccactacaggctagtgccttctcagcaagaactactcttacagtgctaagaggagaaatgggcaaggtggtaagagccagaatatctgttgttgatattacagatacagctctgaacttaagaccctaaaaatgatctccaacctcagttgcctctgagagacttcagcatgatatgtgatcatgtgagagccacgttatgtgtattctttttaccacctcttctgtattcatctggagatagttctcttttctgttttttctagaggaaaaaaacaacgacaaaaaaacagggagatcttagcagaaccaaagcagattagatattagccttgaaaatggtgacagcaatcagtgatattgaacctgaaataatttaaataattatcggggacttaccagagctaagttcgtggaccactgggatttctcttatttgggtctcatagtcttccataaagtgatgggactataattgtccatcttcaagtatccttctatgactcatgtataatcccttgactcttttaggagattcctggcagttaatgtcaatactgtccttcataatgcttctgagttagcttaggtaaggtccttaaatacccaatgacttatactctgaggcttctaaactggtatgtggaactcggtggttgcaacttcacccaaatcctcattctgtgttgtgctgtccctaatttagagggcaaaagatttcaaactcaatcatttcttgttaaattcaactcttggagctccacctgtcataaacacaatcgcatttcccatgtactcaattacttctgtttctcgaatccatcattcatcccatagatattgagtgcctaatgtattccagatatagttctacataataaggatagagcagtgtatgaaacaaagcacctaccttcataggacttattctgaggaggtaggaggggagacaaatgatataataacttagactatatctgagtaatacaacaaataagtctttaaaaacagtggcttgaataagatacaagtttatttatctttcatgtaacagtccagggctaacagagcagttctgccatcctcatcacagggcttctgcctctgggtccaaagtagttgccccaattcctgccatcacatctgcaccccagccagtggagagggtaagagggcaagggtaacacatacatattcttttttagggcacaaactagaaataatacatgcaacttccattcacatctcattggccccaaactttggacaaacccagatgcaagagaagctggtaaattagcctttaattgagaagccaagcgcccagaaagcagggagttagagtatacaaggaaagatcatttttatggatatcagtctcattcagaaataaacaaataaataaatacattagtattcagatggtatatggagaaaaattaagaaaattatgagaggccgggcgcactggctcacacctataatcccagcactttgggaggccgaggtgggtggatcacaaggtcaggagatcgagaccatcctaacacagtgaaaccccatctctactaaaaatacaaaaaattagctgggtgtggtggcacttgcctgtagtcccagctactcgggaggctgaggcaggagaatcgcttgaacccgggaggtggaggttgcagtgagccgagattgcaccactgcactccagcctggacaacagagcgagacgcgagactccatcccccccccaaaaaaaaagttacgagataaggaataccaagaagtgaggaaaggaaaggaggggagcttgttatcttacctaagatgttcagggaagacctcaatgacagttggtaaagtaacttctgagcaaaagcttacaagaaattaggaagccagtcatgcaaatatctagggatgagcctttgagaaaaggaaatagcaagtgaaaacatcctgagatagaagggccttgatgtattcaaggaagtacaaggagaaaattatgatgaaatggagcaaaacaggtaagagagagggtcagagaagtgaatgtgggccttgatgctgaagccattggagggttttctgttgaggaggagtatgggaatgatatgatctgacttatgtttcaaaaagtgtactctagctgctttgtgggaaatataggagggagagagcagaatcaaggaggccatttaaaatgccattgcaaatatccaagagaggtggaagcttggagcagggaaacagtggtggaggtggtgagatgtggttggatgctggacatattttgagccaagaggattttctgataaattgcatttggaaaataagaaaaagcttattcactcaccactctaacagtcacaccagtctataatcccagcactttgggaagccaaggcaggtggatcaattgaatccaggagttcaagaccaacctgagcaacatagtgagaccccatctctacaaaaaaaaaaactctaaaaattagccaagcatgtggcatgcacctgtagtcccagctactcaggaggctgaggtgggatgatcacttgagcctgggaggtcaaggctgtaatgaactgtaatcatgccactgcactccagactgggtgacagagcaagaccctgtctgggaaaagaaaaaggcatggcggggggtgggggggcgggtgtggtgtttcacacctgtaatcccagcactttgggaggccgaggcaggcagatcacctgaggttgggagttcgagaccagcctggccaacatggtgtaaccccatttctacaaaaatacaaaattagctgggcatgatggctggcatctgtaatcccagctactcggggggctgaggcaggagaatcgcttgaacccgagaggcaaaggatgcagtgagccgagattgtgccactgcactccagcctaggtgacagagcaagactccatcttgaaagaaagaaaaagaaagaaagagagagagagaaagagagaaaagaaagaataatcacaccccaagaacatcaagctaggaccatggtgaacaatgctccaagagtgttctgatgctgtaaactgagtgtgatgtgcataaattgttttgcactctgcaggtaggagggtgggatagccaaagctgttcaatataataatattaaaaaataaaatatcaattgaagtaaaatacaaattttcttaagcaatattttaaagtaaatggaaatgttacaacctggatgaggggtgaggaattaataacctctaatcacagaataaaaatggaatgagaattccatctacccaaatcagacaattaaaaagtcgaaagaggttacagtaaaaattgggtaaaactaaaacttaaaaaataatttcagaggatacatgatatactcgtcacacagaaaactccagttgaaccttatggacttgaggaatggatacctttgtttctccatcacttagcacagtagctggcaccatgtaagttctcacagaattttcctgaactctccaaccagaggcaacctttcactctccattcacataacatttccttctttctcttcttttgggaataatgtatcttgcttgaattatatttatctttatgccagtttaattctctcttttagattcatttacatctttgtatcctctagctcattattttttcaaaataaaatggattaacataaacaattattaaagagataaactaaaggaaaatattacaacctggctgaggggcaaaaattatatgttcaacatatatttgataacacatactgagaaaacacggtctacttttacttttcagaagtttgttcatgttgacattgtggggcctagaagatttttatcaagttttctatttttgccaagtcatatgatctgctatagttcagctatagttaaccaaatgtagaaaagaaaaaaattttccataatatctagtaattctccaaaacaagcttgttccttgttataaacactgacattctttgataactctcactttatcccacagaggtcatgtacttatttcccatctgttgtcctatgcttacattccaaattcagttgcattgacttttagaacagctttaggaactgcacccagttttaaaatacattatttgtctaaaaattatgacatgagattaaactgtcatctttgtaggtttctacacatactccaactcattcaccaatccttgaaaagattatgtaaccaatctcaatgccctgacccaggccaagcccatttctacatgtgcagtgttctctggatctgatatttaaagccccttatcctgatactacacaccttttgtcttctggaatgcacctctcttctcatcctttttcaaggcactagaaaagcagaccatttctgcagcacctcaaaccagggtgagaaagctccactctaatctcatcattttagctacatagatacatcggctcaagggaagatgccaagtgtagtactttaccactctgaggatttttgaatctataacagttgtttcaactgggccaataattatgaagggcaataattaaaaagagtatccatagtaaaggagtaagaaaaaaagttagaaaaaaagtagagaaaaatatttactagagtatttactagaacccaccactctcagatcaattttctagtgttctgttgactggcaaccagtcaacaaactttcattgagaagctattttatagtaggcattgggatagcctttgtggaataaataccgagaagcatatgtctctagcagaagacagacaagaaaatgtaaaaacaagaaaaagaaattgaggaataagcctacagtttacaaagctacacaattattcgttatgcaaggaatgaggacttaagagaaagacttccctgtgaactacaatgagatgaaaaagcttctcagagtgagatttgagcaagagtttaaaagaactgacagactgataaaaagcttcaagtagtccagaggactgagtactaaaactcagaacaatgtaacaaaagcacagaagacaaagttaagatgctttacatgacagtagaacatttaggctaagctggaggactggggagaacaagtgaagaaggtaagttttggctagataataggtggcctttagtgtcaggatgaggatttggaagttaatcttttggtcagtgggtaataaatgatggcatttgtgtagttgagccagttgacaatgctttaacaacttcaaaaggccctgaaaaacatggtccctaatccttaagaaaaaaggaactcctgacttcaggaccctaagctaggaggagattggaaaaattctcttatggcccaactgtatagaaaatagaccacctcggccgtctcacttactgagtaacctttcctaccagagaatgtgctatatatgatttctttactttcaacggaaattttggattctcagttatctttccctgacctcttgtctggtgatcagaaaaagatgactaaactgggaatctttattttctagtggaaaaataatcacgtataccacattttatatcttttaattgggtgtaaatttgaacttcaacatcataaaaattagtaaaattcattttaagcacaaagttgttaattcccccaagatttatcaagaatggcttaatttcaaaggctgtcaagttaattataagctaagattttccagttgcaccaagggtatattttatttggcaaaagaaacatccactggcttttgtcaggatgagtcttgagttattcaagttttgaactgagaggtcttcagaaattcaccccacatattaactgtggccttctctacaccacaaattcccctccactcatcctcaaattgtttcctttctcagaacatctgtgacacaaagactgtgacacacccacaggtcgattaacatgaggacccaacacctattaaaacatccacactcctgagaacactaaaaaccaaccacctcgtcaggtcccacctccagtctcgctgaatcaggaaacctcaagagaagcacctggaagcaggtttaacaagcgcaaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcggacgcctgtagtcccagctacttgggaggctgaggcaggagaatggcgtgaacccgggaggcggagcttgcagtgagccgagatcccgccagtgcactccggcctgggcgacagagcgagactccgtctcaaaaaaaaaaaaaaaaacaagcgcaaaggtgactcttataattgggaaagtttggaaccaagacagggttcttgtcctggaggaagtattttcctgtggagaaggacctgtaaacagcctatgaagtgctcagctttcaccaagaaaaacatgggctgatagggttaaggaaaagtttgactgaagaggattaaatcctgaaggttagggatgtctttgggcgctggggtctctcaatcaccaaagatagacattacaggccaggtagctctttgtccccccagaggactgtcctgtgccttatgcttagcactcctggcctctgcccattggatacttctagcacctcccccccaacacacacacacctgacaacccaaaacatctacagatattgccaaatactccacagggggtggggtggtggcaatatatctccctgtttgaagtcactggaatggaagttaggggaggatggctaagtcaggacttgaaaaaaggctaagggacgaaagcacatggctatattagacaaagtttgtgacagacgcctgtaggtatatggtaaggaaaacagattaaaacactaagaaatagtaagaggttggaccgagggtttctcatctgtatgggaaatctcatctcgttcattactttcagaaacaaaaaggaaaacgactttaaagatacaggttaaaggctgaaggggtgtagaaccaccccccgcctccttccctccatccctcccaaatatcccagaacgagtcaaacctttctaatctcgtagcacagataacaagcaactcagtaagactagacggggatgactgagggccaactcattacaggactacaggaaactccttagtcctaaacccgaatgcatccgtgaccatggtaacactccctacctgaccaaaagctatcaaacgctctgacaagtgtttacagctgctttctcgattactgaagtggctctgaaaagagcctttggggttaggtggttgatctattgcgtcccttgcacactcttacttcgagctggtgtacttggtgaccgccttggtgccctcggacacggcgtgcttggccagctcgccgggcagcagcaggcgcacggccgtctggatctcgcgggacgtgatggtggagcgcttgttgtagtgcgccaggcgggacgcctctcccgcgatgcgctcgaagatgtcgttgacgaaggagttcatgatgcccatggtcttggacgagatgccggtgtcggggtggacctgcttcagcacctcctacacgtaaacggagtagctctccttgcggctgcgcttgcgcttctcgccgtccttcttctgcactttcgtaacagcctttttggagcccttcttgggagcaggagcggatttcgctggatccggcatttttgcgcgaaaaaagagaacagagacttaaagaagtaatccgaactaccgcaaaacgggctggttatgcgctacttatagagcctgtatgcaaatgaagactcgcaaagtgctgcgctttaattggttaacttacaacggtgtcgtcagagggggtggagtctatgtaaataatagattctagtcttgcttccttaatggtcactgtaacaaaagtcttgttatccaatcagaatggtccatttcacactaaccagttttaagctaggtgaagcgatagtttcaacggcttgaggtttttttcttggttttcactttccattagacttgcatacggaagaaatcttaacgccagctagacaagttaactctcttgcctcgtttttgcatttttattctatactttgtggaaatttttttctcttccttgaaatactacctcacccacacatttttaaaaatcgccagatatttactcccgcccgcttaaattactattctggcttggacaccgcctgtagtatgcaatgaggaagatgctgagctttaattaagcttatagttcctaaataaaccaggaaacgggtttataatttttaagggactcgccccacccttacactcaggatcttccacatctagaaactccccatagtctcttgcccccatgcaaaactttacccacagaattgggagccggacctctagccttaaaccagcgtgaaaaggctcggccggaaccacaaggaccgtgcctctgcggctttctctactgccggccaactcacggctgggctttgggttctgtaacgtcacccaccacgagtgcccctggcccctgaccgctgcgcaaggcagacgcacatcagatggagagccggtacagctgctcttgatgaaaacggcagtggctctgaaaagagcctttagatcgaccacttaaaaatataccttaggcccgctccccgcggatgcggctgaccaactggatgtccttgggcatgatggtcacgcgcttggcatggatggcgcacaggttcgtgtcttcgaacagccccaccaggtaggcctctctggcctcctgcagcgccatcacggccgagctctggaagcgcaggtccgtcttaaactcctgcgcgatctcgcgtaccagccgctggaagggcagcttgcggatcagcagctccgtagacttctgatagcgccggatctcccgcagagccacggtgccgggccggtagcggtgcggcttcttcaccccgcccgtggccggcgcgctcttgcgggccgctttggtagccagctgcttcctcggggccttgccgccggtcgacttgcgggcagtctgcttagtacgggccatgctgtctcattgatacgagagggtctaggcagtcgtatttatagacatagcctcctcttgattgggcctgaaaaggaaattttcaaacttgtgatctcattggttaaaattcagtcctctttactggggcggaagattgttctgctaatctttcttcccttattatttccccctttcctgatttttttctgtaattttatcgatcacggattgcttttgaagactttcctttaaattagtctaacttttgtaaaagcaatgtataaagtgttttgcatcccattttaacagagatttttttttttccccgaattcaagcatgcccttctatgagctatcagcctgtttcaggttacctgttactgaagctcttctaccatagctaacatttatttcatgtctagcattttgctcagcaagttagatgcattgtataccatgaatgaccgaagcttagcaaaaaaatatgtaattgaaggaatgaaaaaattgatcttatttacttgaccttggaacccagccaaagccatttcatgtggatagtgtgctgacctatattgacctgatattagagcctctgccttcctttagtcttttctccctgcgatgtggttccttcttcctcaccctcacatcaatggccaattaggtcctgcagatgttaagcttctaaatcaaagaaggacaacaccagaaattcatttctcctttacaatgtagaatagtttgtaaattagtgcttattagccagattacaagttaaagtttcaaagcaaattattcatcaattgctgacttgctaacattttattcaataaagtattttataatgcttaaaagtttaatatttttttctgttctctatgaagagagtaaagatgctttgctttttcaatttcatgtgctttgaagaatgtattgttcagaacagtaaatatagtggttatgtagaagcaactgatacttaaaagttgtagtagttaatataaaacttttaatcatatgcttattttactaaaaaaatcattacaaactataaaaactcaaacctgagaaaagcaggcccgaaacgcttaaaacttactttgatggtgtcattatgaactatcttcctactgaagtcaaagtaaagtaaaagtgatttcaaggggacttcctgaacactaaacacaaagtagaaatctgtgagcttaattaatatcttcaagagtctctcatgggcagaagcatcctcctctcgagagatctaaaatgtacaaaagtgtaactgatgtgaacaaatgttatccctctctgtggtagttttgtaataatgccttacagacagcaggcactactcagtgtttaaagttcttctacatacactttatcatttaatccctactctgtgaaatagatcttactcttctcactttacagataagaaaactgagtctcagagaaattatggcttgtcctgggtaagtaacaaagcctgtgtaatattctaaagcaaaagaatgaaacggtaatgatgaaactttctatttcattaggcttagaggataccttttttttttttcatttgagatggagtctcactctgtcacccaggctggagtgcagtggtaggatctctgctcactgcagcctccgcctcctgtgttcaagcaattctcctgtctcagcctcctgagcagctgggactataggcgcaagccaccacccccagctaatttatttatttatttgtatttttagtagagacagggtttcaccatattggtcaggctggtctcgaactcctgacctcaggtgatccaccctcctcggcctcccaaagtgcttgggttacaggcatgagccccacacacccagccaacacagtttaaagcacaaaagcgttttcccatcatgcaatcacatcatctagtatttctcaaacatctacacccaactattcccattagaagggaaaactaccccatggaatctggatgatagcccaaagcagcccacccaagcatcacttttctttgcaatatactttctctatgatgtatgcagtcttgaccataatgtaggatgtgttcatttaaataagaaaatggcattcaatcagactttaatggctataggtatcatttctcagaataaaacaatcagatgtatagttgccttaaaagtcatctttaataacagaattcagatcaattgttagttcaatttcacctagtccccacattggacactagagtgacatttctgtgaaaggtctcaatccaccactatatcagaagcagctttatggtgcaaaagaagctctgcttttcttcagttgtaacaaagacggaatattcctcctaaaatttttgaagtgtccttcagcagaaattataaggctgtgcagcttgaatactgagaacagaaatttcattaggtagcacgggggaatagacaagagaagattaaaatttacctaacaagaaataagcaggcaaaagaaaatattaataaatgaattattaggcacataatgttttgtatgtacatgtgtttacttttaatacaaaagtaacggactaagttaacatagatgttccaataagataatttatgtttcattttttggcttcaagtatcctcagggttataagtatcataagctgagaccggctgaattggtttgtgggttgatgaagccctatgcctgatttgaatttctcttgaatggtctgcagccctggaccaagttgaagaagccatgagagtctcagcttttttccttaccccattatgagataaactcattccttaaatatcttgctcatttgataaaacttggcacccttctcctttctactggtccctgatacttactacctgtactgtaagctcaaattttttacaatttctgcctttattatgtaacgtattccactggaatatgtgttacaggaaaggggtcccgatccagacccctagagagggttcttggatatccggcaagaaggaattcagggccagtccataaagtgaaaacaagtttactaggaaagtagaggaataaaagaatgactactccatagagagaacagccctgagggcttctggttgcccatttttatggttatttcttgattatatgttaaacaggggtgggggaggtggaccacgcctataatcccagctactccagaggctgagacaagatcatttgaacccgggaggcagaggttgcagtgagctgacatcgctccactgcactccagcctggaccacagagggagaatccgtcccccgcaccccacccccccaaaaaaaatcactgccagtaaggaacaaacagccaagacgaagaagtactaagatgtaaagagatgtaaaataggccgggcgcggtggctcacgcctgtaatcccagctctttgggaggcctaggccggcagatcacgaggtcagaagatagagacgatcctggctaacacggtgaaaccccgtctccactgaaaatatttttttaaaaaaaattagccgggcgtggtggcgggcgcctgtagtcccagctactcgggaggctgaggcaagagaatggcattaacctgggaggcggagcttcaagtgagcccaggtcgcgccactgcactccagcctgggtgacagtacgagactctgcctcaaaaagaaagaaagatgtaaaatactgtgatacattctgcaagagttatgacagagtcagaaaggggcaagcgtgtttcttctctaccctgaagcagccaagggagaagaaggtatctgttgccaacgctggggtgttacaagtgcacactgtcatgcccggctaattttttggattctagtagagacaaggtttcactgtgttgcccaggctggtctcgaactcctgagctcaggcaatccacccgcctaggcctcgcaaagtgctaggattacaggcgtgagccaccacgcccggcctatatatgcatatttttttctaacacttacatactttttcttggtgccaagaatgttttaaacactttacatgtattaactcattttatcctcacaaaaccctgtcaagtaggtagtataagtatgtccatttacagattgggagatggaggaatcacagagaggttaagaaactttctcatagtcacacagtcggtgccaaaccagatttcaactccagagtcttcctttagtcactatactacactactaatatcaaataagtaagatgttgatgcaacattgatagtaatttaaaagattagaaacaaccaagagccggggtgtagtggcccatgcttgtaattccagcatctgggagcccgaggcgggcaagtttgttgggagttggagaccagcctgacaacatggcaaaaccctgtctctacaaaaaatataaaaattagctgggcgtggtggtgcgcgcctgtagtctgagctacttgggaggctgaggtgggaggatcgcatgagcctgggagattgaggctgcagtctgcagtgagttatgatcacaccactgcactccagcctgggcaacagagaccctgtcttaaaaacaaaacaaaaccacctccgacaacgtaggaatgctgaaatgagttatgttaattctaagtaaaaactcaacctatcccaattagcccaagaccactacttagtctacctaagccaagtctgttgacttgttacaatgagggagaacacacaacagagaaactggtggcagggtggtgggaggagggtgctcaccaaacaagaggaaaattagagttatcattgattttgggggacgagtggagtgtagttttcataggctcaaagcaaagcagggctgtgtgaaagggtaggcataggatgggactttgaagtggatccagggtcttgtttcctcagaaactacaaagttgagatagaggtggaatgctgtgttcagaaaccccttacttgaagtttttgcacctgggttgaaaattactgctggttttttgtgtcaaggtggcttaggtcctccagacaggagggggatactgcattgttactgattgataggatttcaagcagccaaagttctgatagtctgtgattttgagtacaagttcctcagtgaataagaaaggagtggtcactcaaagaggggagttatgagcctttatagctgtagcatgcccttgggaaaagaatgttttctgtcatttctagtctagctttatctctgttagtgcagcctaatgaatggcagaacaggttttgattttctcagtcctagcgaatttctgcttctcgaagtgcatgttagtggtaatgtgttttatatcttactttatttcttattttccccccctttaatctatattttattttatttattttttatttttttgagacggactctcgctctgtccccagggtggagtgcagtggtgtgatctcagctcactgcaacctctgtctcccgggttcaagcgattctcctgcctcattttcctgcctcagcctcctgagtagctgggactataggcgcgcgccactacgcctggctaatttttgtatttttagtagagacgaggtttcaccatgttggccaggctggtcttgatctcctgacctcgtaatctgccggcctcggccttcccaagtgctgggattacaggcatgagacaccgcgcctggcctaatctatattttaaaaattgaactcttccatgtacccctgaacctaaaataaaagttaaaaacgaacaaacatacaaaacaacaacaacgacaaaaaaaaaaaaaaaaaaacaaaaaaccaggccgggcatcgtggctcacgcttgtaatcccagcactttggaaggccgaggcgcgcagatcacgaggtcaggagttcgagaccagcttgactaacatggtgaaaccctgtctctactaaaactacaaaaattagccgggcgtggtggcacgtgcctgtaatcccagctacccaggaggctgaggcaggagaatcccttgaaccagggaggcggaggttgcagtgagccgagatcatcccactgcactccagcctgggagacagagcgagactctgtctcaaaaaaaaaaaaaagagagaattctgtactttgtaattagaggggtaattcattaattcatgtcaggggcatattattttatttttccaaatgctaggaagcaggtatccatttttgataatataaattttgggataattggcagtcatctggctcacagggaaaacaggaaaaacaagaaacctaaataaacttcatattgatttcccaaaaaaattaccttttattttcaacccttatagaacccaacctgcatctctttgccatccatgttctttttttttagagactgggtctcattctgtcccctaggctggagtgcagtggcatgatcatagctcactgcagcctcaatctcccaggctcaagtgatcctcccacttcagcctcccaagcaattgggaccacaggcgcatgccactgtgcctggctaatattttatttttttgtagagatgaggtcaatctgcattaaacttcatgttgctccaacaccacattttatctccccactttcccagcaatggacaactaggcttgtgccaattctccatcaccaccagaaatgctgcaatgaacattgttgtatatattcccttttggacctatataagaatttcttttggataaaaactcaggaacagaactgctgagaagccagaaaccagcagttctgttcagagtttttatttatatctaattgaactaaggagtgtcagcctcccctccagaatgcttgtcccggacttccaataccaaggtagctggactctgagcccacatccaggcccaatcctcgggtcatccaactttctaagttttgccagactgcctggtgtaaagtggtatctcagcattgctttcgttttcattgttctgggtattcatgagttcaagcatctctacctgagcttgatagttttcggatttcttctcctgtgtattgcctgttcatatcctttgctccaacattgtttatagagcactccctccctactttggcatttggggtcccctaaaccggcccccattgctaaagcttacttctcatgactgacctttgcctatgctgcatgtggtccaggaacaattcttctgtctttgtttttgctgtcccctcttgcctggattacatcatcttctccaaacccccaatctaaacatgtcccgaatcctaaatattctttagaaccaagctcagatatcacctcctcctggaagggttcctttatttgctcagctggccttggcctttccctcttggctcccacaaagctcaacctgcatgtattatttatttatttatttatttatttattatttttttgagacgaagtcttgctcttgtccccgaggctggagtgcaatggcacgatcttggctcactgcaaagtccgcctcccgggttcaagtgattctcctgcctcagcctcccgagtagctgggattacaggtgcctgccaccatgccagactactttttgtatttttagtagagacggggtttcaccatgttggccagactggtctcaaactcctgacctcaggggatccgccccccttggcctcccgaagtgctgggattacaggcgtgagcgaccgcaccaggcctcaacctacatttcaagtcaccatctgtcacaggataccttccactctggctctggatatgggggtcacctcctcacaaagacagacaggttgtatgtgcatacacagaaagattcagaagaaatatgaagacttttaaaatcagtcggatgattttaactttcttctttgtagttttctctagccagttttaaaaactgtaaattgtaggccgggcgcggtcactcacacctgtaatcccagcactttgggaggcggaggcgggtggattacctgaggtcaggagttcaagaccagcctggccaatatgatgaaaccctgtctctaccaaaaaatacaaaaattggccaggggtggtgccgcatgcctgtagtcccagatactcaggaggctgatgcaggagaatcccttgaacccagaaggcagagcttgcagtgagctgagattgcgccactgcactccagcctgggcgatagagcgagactccatctcaaaaaaaaaaaaaaaaaaaaaaaaaaatccagaaaaacaaaaacaaaaaaacctcccaaaaaaccacaactataagttgtaatccatagtgcaattaatttacttggtagagatcatcttttcctttcattttgcccttttgtaagaatcataaaacgggaaaatatcaccaatagtaattatcattttgtgaaacttgttgcaatttttattttcctgtgaatgtgactgggaggcaatgtaaatgtatttcttttttcttgtttttgagacggagtctcactctgtcgcccaggctggagtgcagtggcagatcttggctcactgcaagctccacctcccgggttcacgccattctcctgcctcagcctcccgagtagctgggactacaggcgcccgccacccatgcctggctacttttttttatttttattttttgtatttttagtagagacgggttttcaccgtgttaaccaggatggtctcgatctcctgacctcgtgatctgcccgcctcggcctcccaaaatgctgggattataggcatgagccccagcgcccggccaatgtaaatgtatttcttactgtagacttgaggtcaggagagtgggctgtactgtacacatattgatattatttgtatctattccatgtatcactttctcctaaagcatcaaatctaatacaaaaaaagaaaagcaaaacacaaaacctaggctcaaattccaccttggccatgttttagccgagtaactcacgttccccggtgtctaatctttaccagaaacttccttatctttaaaatagggaaaaagccttttcttctttccagggttgttgtggactcaaacgagaggctgttagtgaaaggtttttgtgagttataaagctcctaggaacccaattatttctgctgccttggccacatagtctagaagaatctctacataattagcatctagagactggataatttacccattattttccatgtgcttgtcttatttcccagcatgatggtaatatttccaagggaaagatctaggatatatatcaagtaacgtttatcataaaaataatgaaattgctaataactattaatttattgtcatgttgagactctgctctaagtactttgtatggactgtatagcaatttatccctgcacgaatcctatgaggtatgtgtatttattgttactgttttacagatattgaaactaagacactgagcctctattttagcctcatgtcttctttccttccagcttttcccaggcaagtaaatgcaggccacagtctgccagctgcccaaccattcaggcttttcattattataggaagcatctggccaaggaccaccaacatcttcctgtcctgcccctgaagctgtgagttccccaagtggagacacagcctgttccccaacacctacactcatgaacacgggagggttggtcaaaattgcaccgctatcatgcttagttttatactcaggtgtaagtgactgatagaagggccttttggaggtggagagtgcgcaggttctgaagaggcaagaccggggaagtctggacctgcttccagagtgtcctcccacaaggcttagtgctcaggacctgtagtgggttgaatatgttccctaaagttcgtgtctatccagcatctcaaaatgtgaacgcatttggaaactggggctttgaagacgtaagtagttaaggatcttgagatgaaatcatgctggatataggatgggccttaaattcaatgactggtatctttataagagaaaggagagggaaattcggacacacagagatgagtaagaagccatgtgaagatggagggagagattggaatgaggctgccacaagccaaggaacatcagaagccaccagaagctgaaagaagcaaggaaggattctccctgagagcctttagagggagcatggtactttatttcagacttctggtctccagaactgtggaagaatacagttctgttgttttaagctaccaagtttgtggtcatttgctatggcagccctaggaaacgaacacaggttgagtatcccttatctgaaatgcttgggactgggactgtttcgggtttcagattttggaatatttgcatatatataatgagatatattggggatgggacccaagactaaacacaaaatccatctatgtttcataaataccttatacacacttacactgtgccccattttctccaacaacttgactttctgtactatagataaacataaatgttttctctcccttttttttttttttttttcttttgagacagagtcttgctctgtcgcccaggctggagtgcaatggcacaatctcgggtcactgcaacctcctggattcaagtgagtcttctgcctcagcctcccgagtagctgggactacaggcatgtgccaccacgcctggctaatttttgtatttttagtagagacggggtttcaccatgttggttaggctggtcttgaactcctgacctcaagtgatccagccgcctcggcctcccaaattgccgggatttcaggcatgagccaccgcgcctggccttgctttttctcttttaaaatcactgttactcatggggtatctgcaggcctttttgatattttcttttttttttttttttttgagacggagtctcgctctgtcacccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccaacctttttgatattttcaacaatatctttataccacagagcagagaataagcaaaaaaaccccacagtgagtaaggcacgtaggtcttggctcctacatggggcattatggggaacgtgctgttgacgacactggcctgcacacatgccattttatgaccctttgtgggtgtgtgcacgttggggaaaccgggcatgtgcagaaaagatatatctcagcggaaaggggctgggagggccttttatttccttgggggaaatactgtgcattgtatgacccgttgtgtgaggtcaggtgtggaattttccaccgaggcaccacattagtgctcaaaattgttcagattttggagcctagggtttcggatcttcagattaggggtgctcaacctgtacaacatccttgcaacaatctaggtgtgagctttcctcaagagcaagaagagcttgccacttctgctatatgaccacggtgaagccagcctgtcaccctcctgccctggatgaccccagggagctctacagaggtccatggctgggggaggccagcaattgtctaggagagctcagtgccacttgcaaagacgacagatctctctacaaattctgggctgagcaggtgaaggaggctggtcaggcccatgaaggagcctagtcagccgtaaggaaaggttcactgtggggcccccgacttcccattcctgatctcctttgtacctctgctgcccacttcctttcctctttccctccaagtataccttatactctgctcctgatgacactcagatctccccccgcccccccgcccctgtcaaataaaaagagcctagtgacttttgtaagaacggtgtattcatttcctagtgttgcattaataagttaccataaacttagtggtttaaaacaacacaaatttgccgggtgtggtggctcatgcctgtaatcccagcactttgggaggccaaggcgggtggatcacctgaggtcaggagttcgagaccagcctgaccaacatggtgaaaacccgtctctactaaaaacacaaaaattagtcgggtgtggtgacgcgtgcctgtaatcccagctactcaggaagctaaggcgggagaattgcttgaacctgggaggcagaggatgcagtgagccgacatcacgccattgcactccagactgggcaacaagagcgaaactctgtctcaaaaaaaaaaaaaaaacatgaaaccaaacaaaacgaaaaaaaccacacaaatttattctcttatcattctggaggtcagaagcccaacataagttttaaggggctaaaacaaatgtctgaaggactggtttgttctggaggctccaggtatataatccactttttgactcttccagcttctagaaactggcattttttagcacctggacagatcactctaatgtctgcttctgtcatcacacccccttctccctgattgaccctctcgtctctctaaggattcatgtgattatattaagggctcatctcaataatccaggataagttctttatctcaaggtccttaatttgttcacatttgcaaagtccctttgccatataaggtaacatattcacagagtccaaggattgggatgtggatatctctgtggggctattattcagtctaccacaaatgtgcactcctttctaaagtatttatcttcgagcactgaggggaactctgccttcagctaaggctacacaactatcctgatggtggactgtagcaacttgtaggcaaggggtacagctcagggcagctacctctccttcttctcgggccaacctggaggaagttccttccagagtccaggctatacttgcttctggcctgcaaattcctgagaattctttgaaacctaggaggggcctgggtattatgcccttttgagtgagaattcagaggccagtggaattagggcaatcaggcatttcctgatcatctgctatgctccaggatgctgacttggagagatgaacaaggcaaaatgctcattctgacggcactcagaatttcacggggaactggaaggataaatgaatctgggaggaactgctaaaacaggtaggagagggtaagcttgttagaacctgagcagaatgctgtctgaaaaggtagagaagtcaggagaagcagtgaggccctcaaccctgtgtgtcacaatgcctcctgtcatttcctctctgagtttccagtacaagcttctcggtggctgttttctgcccaagcacatgaactttggaagacctagcactttggacaaagtccctggccctgacacttaatagtttggggaacttgggcaaaatactcaaagcttcctagtctgtaaagtgagaatgacaaaacatctgccttccttgcaggattgttgtggtgatgtgtaagacataaaatatcaagcatagtcagcagtcactgagcttaaggaatgttaagttataatcattatttctgaacttcagtgcccaatatgaccctgttgacacctcctttgcctccttgggacatactctcttctggtggtcctcatccctttccagctatcctctgtctcttggtattctcctaatctaccaactcccatcaatgttcctgcttgcccagggtgcctgtctcagtcctcttcttttctccctaacccctgggaagatctcatcaaattccctgcctctcgttttccttatcgatttgctgagggcttactcacaagtttctccagctgagaccctttactgatgagagtaataacaactggtggaagtgttctcctaggtagagaacaggaatctcaatttttaatgttgggagggactttatgcatctttttgctttcaaaagcaatttctgcctgggcgtggtggctgatgcctgtaatcccagcactttgggaggccgaggtgggtgaataacttgaagtcaggagttcgagaccagcccagccaacatggtgaaaccccgtctctactaaaaatacaaaaaattagctgggtgtggtggcaggtgcctatgatcccagctacttgggaggctgaggcaggagaattgcttgaacctgagaggcggaggttgcagtgagcagagatctcgccactgcactccagcctgggcaactgagagagactctctcaaaaaaacaaaaacaaaaataaaagcaatttcttctctctgcattctccatgttactgaaacctaacatcaaccccatagctcctcaggccagaagctcctttattgcatgcattctccaaatgcctaaatcaccaatttttttttctttctttctttttttttttttgatacggagtcttgctctgttgcctaggctggagtgcagtggtgcgatctcagctcactgcaagcaactcctcccgggttcacgccattctcctgcctcagcctcctgagtagctgggactagaggcgcccgccaccatgcccggctaatttttttttttttttttttctttttttttagtagagacggggtttcgccatgttagccaggatggtctcgatctcctgacctcatgatccgcctgccttgtcctcccaaagtgctgggattacaggtgtgagccaccgtgcccagccttttttttttttttttttttttcgagacggagtctccctctattgcccaggctggagtgctggagtgcaatggcgcaatctcagctcactgcaacctccgcctcccgggttcaagcaattcttctgcctcagcctcccgagtagctgggactacaggcgtgtgccaccacacccagctaatttttttgtatttttagtagagacagggtttcaccatgttggccaggcttgtctctaatttctgacctcatgatgcgcccaccttggcctcccaaagtgctagaattacaggcgtgagcctctgcgcccagcctgtttcttaaaattaatatgtcttattgcatatgtgaggtcaaggtgtcatactgtctcatcatttccacctcctctttcacaattcccattctccattttattaaaaatgaatgaatgaataaatgattatcacatgtttaaggcttcctgaatttaattatggggcattccattggggtgtaattacctgcagcataatattgtagaacaactcaatatatggaagcctcctttagtcaagaaattgtaatcctacactaaggctacatgtttttgtctttatatttttgataagggtgcagcataatatagaaacaaggtatttggggacatcctgaattcatgtacattgaggagtgaagtggcaggagttatggcaaattttgttgaagggtcttgccttttgcattgcctaattatgatcaaataatgcattgctactataggagagttctgagagggcaaagtagagaggctcagtacaaaatacagaacttatcagagctcattccatcctggagacaaacttatgacaagactctgtgccttatccacctccctgcctcctttccttcctgtctttttatccatcttagaattaagatatttaaattttgtctgaagcatgtcagagaataacaacatgctataaaatttcacttgtgttcacccatgtgtcagctgagtattttgcattgttacatttttattttactgtattttattttattttttttttgaaatggggtctagctatgttgcaaactcctggcctcaaactcctgggcgcaagcaatcctcctgccttagcctcccaaaatgctaggattacaggtgtgagccactatgccctgcctattttgcattacttcaaagagaaggtgaggtcacacatttacttccaacagatcaacattatatcttcaagttagcaaaagcaattgaaagtaggtagtggcattctatatttccataaatgctcctttagacttgtaaaaaaattatcattaattttggccaaaagcttattgatgtcataaaaccatactcagtttttacttggacacattctcctgctgttcctcatcaaccactttgtgggtttagtcattcaaagtatgtacttactagatttagattaattcaatggagatatgttgtgaattcaactgaaaataatgcacttaaataataattactgtatcttttgtaatcagcacacttaccagagcttcaacacctgcctttccttttgctatttatttccacaagatagattaaactacatttttaacagtagaacatttacttatgtagaacaaaatgttcctaagctgtaaactactgtgtaatgacctgaacactctagaaagccagcttcattacatttgttttgggagtgcgcacataaaatgttgaaggaccactgtattaaaaggctattagcataatctctaggagacacaaccagaaaaccaagcatagaggctgagcagccagaaccaatactgctaccgctgtccctgccactcaacacaggccaaatagtgggcagggatgctatgccaagcccctgccttgattctctctggaaactggatgtatctttgctgcctctctgctgtcacctgaatggattccctcaggaccccgtcttcatgacttcagtcttccacactgaaatcacatgcaggagcactgattggtggagtctgtgccacaatttttcctcacttcaagggaatctgggaaaatttggcctctattttcaaaaggcagactcactagatgggagagtcccaaatataaagagtattcaaagcaactagagagcttagaaaaaaaaaaagaatgacaaatgctatcacacaaagtatataataacatatgattttaaaaacaaatattttctttaattcattacatgatcgaggattgcatttatgatgttcattttactctaatgctttactataacactgagccagttttatgtttctccccattcaaaaaatgatgcatgctcctcaaatttactttaaattaattgcatgaaaaaggatgattagtcaataaataagtcttgaaaagacatattctatagtgttcggtttggggttttcagattaaaatacacattgaaatttactacatgatataacaagaaaaaaactactttcaaggcctgatatttgattcttctatcttgtatttgagaaaccaatgtattttacagatttttacaaaacaaagtagatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaacaaagtagacattaattccacttttaaggatgtaaagcccccagggtaacatggtaaacctgtcacggatcatgacccactggataggaaacactgttttactattctctgggaggtatgtgaatctcaacttcctgttgcttcctgaatctacttgtgacacagtcacaactggagtggcagtagctaatcccggactgtccctgctgcttgagatcatctaatcagtcactcctccacctcatctttgtctgtttgatgttgaaattgtattacatgcttgaactgatcaacaattagatggctagagaccattttgactggctgcctcccagtcctgcaataaaacacaacaaaactgtaaaactatcccaacccaagaaaccagagaactaacccaacccaagaaaccagaggactccctgcgcaagaaatccacactggccctagagtgtcccacgcaggtttgaacagcaaccctggacctgtgccacaaactcaagtgcaaggggactccggtggaccctgtaatggcctatctgatttggcttctcatttacagagaatggagactttacacaccacaatgtattgtttgcttaaaggtgcttagaaagaacaacctgaaaccttttaatcttatttgttcatgtagaaatgaaaccgttgagaccttatcttaatgcatatagtattccagttgtaatcagcaaccttttagttaaaggaaagtaacagccggttgagattgttacttttccttttaccaacccataaaatggagacaagggactagattaaatactaaaacagggaactaatctttcagcagccctataggagttagaagcaaaggctcctgggccgggcatgatggctaatgcttataatcccagcactttgggaggctaagacgggtggatcatttgaggtcaggagttcaagaccagcctggccaacatgatgaaaccccatctctattgaaaatacaaaaaattagccaggcatggtggtgcaggcctgtaattccaactactcgggaggctgaggcaggagaatcgcttgagcctgggaggcggaggttgcggtgagtcgatatctcgccattgtactctagtctgggtgtcagagtgagaccctcttttttttttgagaaaaaaaataaaagaagaagcggaggctcctgctgttgaatagacaccctttgaggcaatgaatgacacatgttagcaaggagcccatcttatctacgactcatcctcaaaaggtccccaacctgaagcagccagtgcctgtggtggtgtagatggtgtctggaaaggctgagaggacctcacttctttcactcaccaaattgagtacctgtaatcccagcaccttggggtgccaagacaggaggatcccttaaggccaagagttcgagaccagcctgggcaacaaagtgagaccttgtctctataaaaaatcagaaaattagccgggtgtggtggcaggtgcctgtggtcccagctacacaggaggctgaggcaggagaatcacttgagcctagaggtcgaggttgcagtgagccatgattgcaccactgccctccagcctgggtaacatagcaagaccctgtctttaaaaaaaaaaaaaaaaaaaagattcgaagatctttgaacattatagagaacattacaatggaatgttatagtattagtattgttgatattttaaaacccaggagctgttagctcctcctctctggcctcttaatcataaatccctgtcccttctctattgggttacaagtcaactgaggcaccagcatgtaagcctcatctatacttactcaactaattcagacaggtctaggcctgtagggggtggcgtggggtgcagtctgggtgcaggggagagatggacccaccagggagagctaattatatcacaagtagaggaacctgtgggaagagtatagtgttggacatgtgggtgctgctttataacctcttcatttctcaaattcctcaaggagaacctacattaaggggtgaccaaccagctgaacaattccctttgctgtcaatctatgacgaggggtaaaacatgactagtgcactaaaatatcactggaaatagaacttcaaagatgaaaatttttttaaatcagaaatctcacagagagtactcaatagggttggagtaaataccttgatgagccacttggggatgggggtggaaggtaagaccccaaggggtatgcctggatgacaacagatggtccttctaaaaaggatagtcaagtgaactatgaggctgttgttttggagagaggttgtaagtttggggccagagttaaagccccttggattttggaggctttgcagctgatggtcctcctctttatcctttttctacagggcactgaggaactatttaaagaaaatacaacccaagtatctgcaggtctcattctggtccagccccaaagcagtgttagctgcaggggaaggccttaccctgaggagagggagataggatgtaccagctgatgtgggggagtgaggacacaggattagaggggagtggatactgtgaattgcacctagaaacaacagcgctaaggcaggcttcttccccttgaactatgcttccattaggggaagaatgcataaaatgagtaaaataaaagctgcagaccaggcatggtggctcatgcctataatccctgcactttgggaggccatattgtacggattgcttgagcccaggagttgaagaccagccctggcaatgtagcaagatcctgtgtctacaaataataatttaaaaaaattagcctggcatagtgacacatgcctatggtcccagttactcaagaggttaaggcaggaggattgcctaagcccaggaggttaaagctgcagtgagccatgatcatgccactatactccagcctaggggacagagtgagaccctgtctcaattaaaaaaaaaaaaaaggtatattccctgggccaggttttctctctctgtttatctggctaactcaaatttaacctttagggttgagattagatcttacttctcccaggaagccttttctgatctcctaagtctgcattagatgtcattcctctgtgctccgacagatcctgtatttcccccatcatcacagcatttacagtgtgcattgtcattgcttggttacaaggcaatttcctttgctagtctataacttccatggggtagggaccatgtctgtagttcactgtcgtttggtgccaaacatagtacctgatacctggtaggcactcaattatttgttgtttgaatgaaataatagaggcacaagaatagtgctgccatgtacctagaagaggtggaaaattttcatggtggagggtggctccctgaggccaggccttggtatagaggctgatggacagaacagtagctcgtggatttcgggggcagtgatggcttcagacagcctgatacgttaggaggagagaggataccaaaacagcaccttcgaagtcaggagctacgtggaaacagaatggaagacatcagctaaaagacaccctagggacttctgcctctcctcaccctctagcaatataagtgcggaaggagaaagtccccaaatacagtgatgcaccacttaaaaatgcattctgagaagtgcattgataggtgattttgtcattgtgtgaaccttatagtatgtgcttacacaaatgtagatggtggagcctactacacacctagcctgtatggcgttgcttattgctcccaggtggcaaacacgtatagcatgttactgtactgaatactgtaggcaattgtaatacaatggtcagtatttgtgtatccaaacatatctaaacatagaaaaggtacagtaaaaatatggtatatgtgatattttggtatacatattggctttcgtccgcagctcctgactcataactcccatagcccttgttatataatgttggggtgcttcaggcctcagaaaacagaatgtctgtctctctggccttccgaccacctcctgccctcctttttctccccaaggcaggactcttctctcacctctcttggagctgaccataaagaaattctcttacctaccctatctgactgtaggtcataagaacccccaattcagaaggagtcctgccccacacccaggaagaacaaatgctgcacagagatgccaagaagaatctgaacagacaggccttgctgggtttctccactcagtctattagtattagaccatacccttcttgcccatttctgcatgattgtcaatcatgactacccaatgaagtctccacaaaggcacaagaggactgggtacagagtatttccaggtagctgagcacatggaggtttctggagagtggcacacccaagcagggcatggaagctccgagccccttccccatacctcgccctgtgtgtctctgcatctgcatgctttgtggtattctttataatatatcattttttgtgtattataaagaatatataaatgtgtttccctgagtgctgtgaacagcactggcaaattaatcgagtcaaaagaggaggatgtaggaatctcaacttaaagccagttggtcagaagttccagaggtccagacttctgacaggtatgtgaagtaggggcagtcttggggactgtatgatctgacactatctccaggtagagagcatcagaatgaattgaactggaggacaccaagctagcgtgtctgtagaatcgactgcttgcttggtggtggcaagaaaccgccatacatttggtctcaggagtcttttgtggttgtgatgtgagaggagagtaacaacagtttttgttttttccactaagtataaaagataaaaacgtatactcctgtatagggcacttaccataaatagagtttgcaggactcaacgctgttctgggtgagtcagtgagtgagtggtgagtgaatgtgaagggctaggacattactatacactactgtggactttataaacactctatacttaggctacactaaatttaacacattttttttctttaataagaaattaatctcagcttactgtaaattttttactttataaactttataattttttaaactttttgactcttttgtaataacacttagcttaaacacaaacacattgtacagctgtacaaaaatattttctctgtttatatctttattctataagctttattctattatcttaaatttttaattttttctttttttttttgttaaaaactaggacacaaagacacacattagcttaggcctacacagggtcaggatcatcaatatcactgtcttccacctccacatcttgtcccactcggaggtctttagggacaataccatgcatagagctgtcatctcctatgattacaatgccttcttctggaatacttcctgaaggacctcccagaggctgtttaacagttacctttttttttttcaataagtaggagtacactctaaaacaacaaaatatatagtaaatacataaaccagtaacatggtcatttattatcattctcaagtattatgtactgtatataactgtatgtgctagactcttatatgactggcagcaagtggatctgtttatactgggcatcaccataaacacataagtaatgcattgtgctaggactttatgacagctacatggttattaggctacaggaatttttcagctccgtgataatcttctgggaccccgtcatatatgtggtccatttggctgaaatgtcactatgcagtgcttgactataatcctgcttgcagcattttgtaccccaaccataccctcaggatgatatgcctggagaaatgccagttacacctggccgtaacacccacagtcttggttcatgttctcatcatcacagttgcattagatgccttaatgatcaccctcctctatttgggccatggagccctttgagaatccaacaataactctgaacctctccacagaagaatcacatggtcacacaagcacaaaattttacatataacagacaacccttaaaagctaatctacagaccctagctctcatcttaatcttttctaaatttttctccatagtgctgccagggtgaacttgaaaaataaattttattgcattgttggatttttattaccttcagggaagacttcaagctccctagtaaagtacatgagacacctcccacatactgctcacgttccttacctaccttttttactccaccactgctgcagcaatgagctggtgtgacccatttctttggagaaatgtctgctcagatcctttgcccattctttttggttcccaagttttattcaagaattcattcaaaatattccagataaataaaatttaatcctcatctttctcttcttctttgtcctggttaatttggaaataacgtaattcataactctctttactgttagcaactatgcacaaccaatcacatagattattgttcttcaaatattttttggtgagatatttcaaataccttctggaaaaaggcacttccggtgttacggtgagcttgctcttgctcctttcgatggtcaccactcctccaagattcacagcttttctgttcactttgatcctctcttgcaaaaactgctcaaaattggtagaatggcggcatccatgattccatcttctatggggtggatgcaatcaagagtgaacttcagaacctgcttcttttttgccccctttcaccacaagctttttcgcgggcgccatggtggcaatggaggcagaaaagccctttgcccatttttaaaattgggttatttgttcttctgctattgagttgtaagagttccttatattttttggatattaattccttatcagatatgtggtttgcaattatattttcctagtccgtaggttgcttttcaagtttgttgattgtttcctctcctgtgcagaattttttagtttgatgtagtccctttatttatttttgtttttgtagcctgagcttctgatgtgatattaagaaaaagaaaaatcaggccgggcgcagtggctcacacctgtaatctcagcactttgggaggtcaaggcgggtggatcatttgaggtcaatagttcgagaccagcctggccaacatggtgaaaccccatctctactaaaaatacaaaaattagccaggcgtggtggcacgtgcctgtagtcccagctactcgggaggctgaggcaggagaattgcttgaacccgggaggcagaagttgcagtgaaccaagattgcgccactgcactccagcctgggtgacagaacgagagattccgtttcaaaaaacaatcattgtcaaggcaaatgtcgagaggtttttcccctgtgttctcttctaggagttttatggtttcaggtccacagtacactgttagtgggaatgtagattggtacagtcattataggaaacagtatggaggttcctaaagaaattaaaaatggaactaccatatgatgcagcaatccctctcctgagtatattcccaaaggagaggaaatcatcaccttgtaaacatgtctgcactcccctgttcattgttatgttattcacaatagccaagataaggaaacaaactaagtgcccattgacatttaggatggataaagaaaatgggttttgtggtgtacatacaaggtattttcaaaaagttcatggaaagtctgtattatataaaaaaaaaaaaaaaactatgtggccgggcgcggtggctcaggcctgtaatctcagcactttgggaggtcgaggcgggcggatcatgaggtcaggagatcgagactatcctggctaacacggtgaaacaatgtctctactaaaaaatacaaaaaaaaattagccgggcgtgatggcgagtgcctgtagtcccagctactccggaggctgaggcaggagaatggcgtgaacccgggaggcggagcttgcagtgagccgagttcgctccactgcactccagcctgggcgacagagcaagactccgtctcaaaaaaaaaaaaacaaaaacaaaaaaacaaacaaacaaagaaaacactgtgtatggatttcaaaattgttcacaacaaaataaactagtactaacttgtttataacatgtctggtcaggatctagttagagacactaaggacaacacatcagtttgaaaagagtcccctgtcggagcaacatgaattctgctaaaattgaagcaagaacaagcatcaaatgtatggtgaagcttgtgtgaaagaatgatcaaatcactgattctttacaaaaagtttatggaaacaatccccaaagaaatcagcagtttacaaatggataacttgttttaaaaacagatgaggcaatgttgaagatgaagcccatagtggcagaccatccacatcaattttcaagggaaaaattaatcttgttcatgccctaattgaagagaattgatgactaacagcaaaaacaatagccaacaccagagacatctcaactggttccacttacgtaaatctgactgaaaaattcaagttgaataaactttccacgcaatgggtgccaaaaccgttgcacccagatcagctgcaggcaagagcagagctttcaatccaaattttaaagaagtgacatcaagctcctaaagcaaaacaattgtaatgggagatgaaacatggctttacaggtacgatcttgaagacaaagcccaaagcaatggccaccaagaggtggaaatggtcgagtcaaagcaaaagtggattggtcaaaagaaaaggtcatgacaacagttttgtgggatgctcaaggcattttgcttgttggcattctgaagggccaaagaacagtaacatctgcatattatgagagtgttttgagaaagttagccaaagctttagcagaaaattccctgggaaagcttcaccatagagtccttctccaccatggcaatgtccctgctcatttctctcatcaaacaacgataatctttttagagtttcattgggaaatcattaggcatccaccttacagtcctgatttggcttcttctgacattttttggtttcctattcttaaaaaaaccctataaggtacacccatttttcttcagttagtaatgtaaaaacgactgcattgatgtggttaaattcccaagaccctcagttcttcagagatggactaaatggctggtatcattgctttcaaaagcatcttgaacttgatggagattatgttgagaaatagtttatattttcaatttttatcttttaattccatttttccgtgaaccttttgtagctccccccatacaatggaatattatgcagtcttaaaaaaagaaaaggagaccctgtcatttgccacaacatgggtggacttggaggacattaggctaagtggaataatccagatacagagagaaaaacattgcatgacctcacttatacatggcattttaaaaagggctcaaatacacagagagaatgaaacagtggttaccatgattgggtggtggggagaggaaatgagacactgtaagtcaaaggatacgaaatatgaaaagtctccacatctaaggtccaacatgaagactaaagttaaaaaaaactgtatcatattgggaatttgtgttaaataagtagattttagctgcccttgtcacaaaaaagtaactatttgagatgatagaaacattaatctgcttcataactgtaaccatattactatttatatgtatcccataacattgtgctgtaaacctcaagtatacacaatttaaaaaattttttggctgagcacagtggctcacgcctgtaatcccagaactttgggaggccgaggtgggtggatcacctgaggtcaggagttcgagaccaacctgatcaacatggcgaaaccccgtctctactaaaaatacaaaaattagccaggcatagtggcacacgcctgtaatcccagctattcagaggctgaggcaggggaatcgtttgaaccctggagttggaggttgcagtgagctgagattgcgccattgcaccccagcctgggcaacaagagtgaaactacatctcaaaaaaaacaaaatatttttttttttaatgacctctccccaattttcattacctgaccttcctctaggatctcatggtcctgggctcccctcttcatagcacttactgctgagctgtaaatatccatttatgtgttgcctccctcactggactgtaaaattcttgaggcagaaccagtaggttttatctatttatccttctcaagcctaggacagtgcctgagaccttgaaactcggtgattgttggttgacaggttgaatgagtgatctatgagatttctgaatcaagcctggtgcatttaatctttgggtcttgataacatctggatctgaatgaatctgggggaaagtctaattgagcttgatttccctgtgacctgcagaggcaggagtcccagcttgactggtagagtgggtggggaaggcctcttctacagcacagccataaaaaatctggaattgtgacactttcccctaatgggcctcctgggactttacatgtcctgttgtggggagttgattttaacacagaatctgtcaatgctctatccttttcaggtccagcttcataaaaatattcaaggaatcatgtcttctgattttgcttgatgatccctcttgggagccatatttgaaaggttacagtttgcatttttgacattaaagtttactttttaattttaaaaaaagttacaaagatgtaggacgtttggcttcttcaatacttatttgctagaagactttgggcaagttacctaaactctctgggcttcaatgtcctcccatacatgtaagctaaatgttccagggccacctatgcccatgggtaacaggccagcacaagaatatgctgaccaattgattcctggctgcataaccacagaatctcctctgttatttctaggtgcctagaggaggtctctcatagatgcccacgttctcttgacaagatatttggggaggacccctggctactgtcactgctgccatgcctgccaggaggaggcaccttcctgacacttcactgctgctgctcagcaggcctgccaagtggttctgctgtgttctaggagaaacaggaaaaatgcctctcctcccactttgcactgtgctttgtcacctgggccctaaaacaccattgcctgcccctgacgccccaacagctccctctaccaaactgaggctgggctgggagactaggcactacaccattccattctcccttctcttcttccattctcccttccctccctctcttcttcccactgcctccaagacacctgtactggaactttgtccattcttacactcacacacacacacatgcacatgcatatgtgtacacacaaaagtctcttgtccatcagatcatacaaatatatgcttgggacaggggtgatcacatgccccacatgcccagtggacatttaggctcagataggacaattctttcacaaggatgacaaaacctaccttccgtggttgctgtgagaacaagaaattgtacatacagtgcccattctacagcaaacccaacaatgatttaaaatccacaataggccgtgcggtggctcacgcctgtaatcccagtactttggggggctgaggcgggcggatcacgagatcaggagatcgagaccatcctggctaacacggtgaaaccccgtctctattaaaaatataaaaaattagccaggcatggtggcaggcgcctgtagtcccagctacttgggaggctgaggcaggagaatggcgtgaacccaggaggcgaagcttgcagtgagccgagatcgtgccactgcactccagcctgggcgacagagcaagactccatctcaaaaaaaaaaaaaaaaaaaaattccagaatatatagagagcaccttaagagtcaataagaaaaaaagacaaaccaatatacaaaaagtgagcaaaagatatcaacaattaattgaaaatacaaataaccaataaaaatatgaaaatatattcttaatcttattaagtatgcaggtaaagacaaattaaaacaatgaaataccaatttttattcatcagattggccaaaactaaagcctgaaaatataaagtgtccatcttgctgtgtgtaaatgggaaatctgaatctgatggtggaggcgtaaattggacagctttttgaaaagaatgatttagcagtatctattacaatgaaaaacatagatacctttgcctcagtaagtttacctccaggtgtgtatcctaaagaaatacttagaaatgtacctccaagagacatgtacaaggaagttcccttatgcattgtttgtaaaagtaaaacagtgatgatctcaatgcccactgataggggaaaggtttaattcaccatgattcataaataaagagaaattctatataaagtggaatagatttgtgtggcatggaaggatcgccaaaaagtattttaagattaaaaaaaaagtaaaaaatatgtgcagaattatgcctttttttcatagaaaaaagtctaggggattcaccgctcagcaggccatcctggctatctgggcataaccaccacccagagtgtaatttcttctaaggcaatcacccaagtctttcacattttataccttcacagccctgacaaaaactgctacataataaacactaaacaaatgcctatgaaaggcaagaaggacgtaagagagggaaagaagcaaagaaatgaacaatcgtagcacctgaggccggattaaagaaaggaaaaaagcttgtaagggtcttttcatattgacaaagctttagtggaacactcttttggtgggttttcaagggatcagaacgtttgggcagaaaacagaaaaatacagacataaagaagagacctaaatatataagcataacattgggaaaaagccttttcagaactgcaactcatgccttattcgaacatgttctgaacaaggtctcttatctaaagttgtttctggcttcagacagcaggtggcagcagaatcaagctttctggttgcagaaacttctggagccagccagctgtataaagtttcaaatggttttcggaggagaagcagcttttgagtaaaaacctttaatctaaaaatctaaactcgacacaaaacaaaaacaaaacagagtgaggagctggtgccattggcccctgccatgacagatcctgatgtcattccctgcctgccatctacagagccacaccttgtccttcgaagaaattctgggatttctactggcagcggccaggaaaggaacccaaggttggtctgtcctgttctgacgttgtccttgtcacatgtggaagctggttcgccaggaaacaggctctggtcaaggctgggctcactggagaggtcagcccaaactcaaaacacatttatgggtaaaggaagggttttttaaaaggagactttgcaggcaacaaaaagaaatatagtattgatatatgccacaatgtggatgaacctcaaaaacattatgttaagtcaaagaaatcagtcacaaaaagaccacataatgcatgaaaccatttataggaaatcttcagaataggcaaatctaaagacagaaaatagattagtggttgtctagggctcaggaggtggtgactggggaatgactgctaatgagtacacaatttctttggggagtgatgaaaatattctataattagattacagtgatgatgcacaattctttaaatatacttaaaaaccattgagttgtacgctttaaatgcgtgaactttatggtatgtaagttatctcaataaagctattaaaaaagggaaaaaaaaaagggcccagcactttgggaggctgaggctggaggattgcttgaaaccaggatttcaagaccagcctggacaacatagtgagaccccccatctctacaaaaaataaaaactagctgggcgtggtggctcatgcttgtattcctggctactctggaggctgaggctagaggactgcttgagcccaggagttcgaagacacagtgaactatgattgtgccactgcacttcagtctgggataaccattcaatgctgggggggtggggagagagagagagagagagtctatgcagttgctacagaaaagaattggagattggttagagatatgactggtacattgatgaattttactttttgatcagattgtgatatgatggtagcataattcgcttcctgatttggtcacacacacttcctatccctaagaactgcaaatacttacctgaaagagtggatgaggtgcgttgccatctcacttttttaggggatggtgctctccctggaaagaaggcaataacaggccagtgaaatagcagacatctgaagtcacacagacgtggtttcaaattccggttcttcctcttattagctatgagccgtcagcttcttttccatacccacatctcaaggttaagtaagaattacaacataaaatataaaagtgcccaacccagagtaaacttgaaatttatttaatattcttggaatttccatcctgaccagtaagatgacattttatctcaaaacacagctgtatcatgttttgctattggtacacctctaaagatcttctccaccgccctctgcccccaccccaactccaagtgccatgaataacctaacttattatcactttttacaacgatgagcagcctctgagaatggaaaaataagtcaatggtaatactgtgttaggaaggatctgagtaggagggaacctgtcccctggctaccagaaacacaggactagacccagtaatacacacctagaatataagcctggataacaacagtgcaggagaaacactgtcctcaccaggatagcttttatatgcaagaatttaggtattataatcagaaagatttctagaaactatgaaatattagggaaaaaagccaacacattagccaacattgtactttacatttatgcaaattttaaactctataggcacctcctagtagctttgggggaaaataatactctgtgcatcgtgtaatggataagaaaatgagttaaagggccgggtgcggtggctcatgcctgtaatcccagcactttggaaggccgaggcgggtggatcacctgaggtcaggcgttcgagaccagcctgaccaacatggtgaaaacctgcctccactaaaaacacaaaattagctgggggtggtggtgcatgcctgtaatcccagctacttaggaggctgaggcaggagaattgcttgaacctgagaggcggaggttgcaatgagctgagatcgcacccttgcactccagcctgggcaacaacagcaaaaactccacctcaaaaaaaaaaaaaaaaagaaaagaaaagaaaatgagctaaggagctaggcttccttatttcacaaccttggctctgtctcctatgaaaccagggcaactatttaacccctccatgtctgagtttcctcatgtataaatgaagggagcaatagtacctagcttataaggccattataaggattttaaaagttaatctaaagtgcttaggacagtgtatggcatagagcaagcactcagtaaatccattcattcaataaatgtttattgaatataggtgtggctgctgttttggctgatgagtatactaaagtcagtgaaacagacgaaatctgtggagctttcttccttgggggaggaggccaacaacaacaacgaatacacacagaggaagagcaatggaatgaattgtgttccctcccctcccaaattcatatgttgaagccctaactgccaacgtgatggtatctggagatggggcatttgggaaataattagatttagaagagatcatgaaggtgggagactcgtgatgggattagtgcccttttaagaagagaaagagtcaggtgcagtggctcttgcctgtaatctcagcactttgggaggccaaagcaggaggatcgcttgagtccagagtttgagaccagcctgggcaacatggtgagacgccatctctataaaaataaaaataaaaaattagcccagtgtggtggcacacacccatagtctcagctacttgggaggctgaggcgggaggttgaggctgcagtgagctatggttctcatcagtgcactccagcatgggtgacagagcaagactgtctcaaaatgaaagaaaaaacaagagagagagagagatacaccagggctctctctatgtcctgtgaggacacagcaagaaggcagctgactgcaagccaggaagagagcccttaccaggaactgaagctgtcagcacctttatcttggacttcccaacctacagaactgtgagaactaaatgtgtgttgtttaacagacattttgtctatggtattttgtttgttgttggtatttgttgacattttggtattggtgtgttgtttgttggtattttgctatcagcaacccggcagactaatatagatttatatgtaaacatatatttgaataggaaccctgcagaagccacatagctggttttactgatgcaaagagccctatgctatagtatgatgaggtgaagggcttacatttccctttcagcagtggtatccactctccacagcgtagacttggagaagccacttgactctcatcttagattcctgcatctgtaaaatgatgaactagatgatacccaaaattttagattctatccatcttatggttggaataacagcccaccttctaggtcaattacacacacaggtgtgctgatgcttagggtggcagagagggtgtcccacaagtagacactgattatcctaactgtaactttcaaatggaaaattaattaaatctctaaatttggatttggcttcctagttagcactgtttccttcctggaaaagaaatagttatgtgtcagacagaacagccccctctgatcatttttttccttcttccttgcattattgttagctctgactgtgcagctctcctggtgtctctccctttctagataacagcctagaaaaaggagcttatggtttccctgaggttcttttgataaatggctgacatttgattgaaccattctcatttcacttatttttcactttcacagaaaaactgtagtaggtataacagcacaaggtaatcatttttaaattattcagacatttttaaaaatttgattctgcttctctcacctctgaaagatgttactggggtgtcttggttgcaaagattcattcaagttcttttgcttttggattctccatattctctgaggaagtgactgcatctaagactgtgtccaaggaagcatcttatcactttcatcctttgatccctgagtgcctttcactaccagatatactaaaacaaaaatcttctcttagctccctggtgcagtggagttgagggataaccacaaagaattcagagtacatcacataacggaactgtcaggaagcttttgatggcagaaacatattttcctggtgatgagattagaaggatcttcatataaccatcagatatgttattgtcacttctgaacaatgctttttatagcagattgtttctcaaaaaggaaatagaaatgcgattttaaaatatgaaaaatatgttcaatctcattattaagataaatgcaaatacaaattataagaggacttaacagattggcaaacatcagaaaagtgaacaacctcctccactggcattcttttttttttttttttgagatggagtttcactcttgttgcccaggctagagtgcagtggtacgatctcagctcactgtaacctccaccttccagtttcaagcgattcttctgactcagcctcctgagtagctgggattacaggctcctgccaccacacccgactaatttttgtattttcagtagagatggggtttcaccatgttggccaggcttgtcttaaactcctgacctcatgatccgcccgccttggcctcgggagtataatttgctgtatggagggcaatttgacagtatctatcagattttataatgtacagagccttgaattcagtaattctacttttaggaacttatcccacagatattccagacatgctcaaagatgtaggtacaaagattttattgcagtattatttgtaagagtaaaaaaccagtccatgaggaagactagttcaataagttaataatctagaatatatcgatataatggaatactatcaaagaacaattttcacaatgtatttttaagagggggaaggtacagaaacatatgtaaggagtttcatttgtttaatatacaattagtgacacaggttgcatctggggaggaaaattagggaacaattttttgttgtacacctttatctttcattgtatctctttcaaaaccttttgtaccatttgtgtgtattgtgtattttaaaaattaatttaaatttcaacaaccgttatagtgatgcaaaaaaccctatagaaataacagtttacattcaattttgctatatgtcaggtactgatttttcaaccacaaccttgtaagatacgtgctattatcatccccacttcacagggggaaacctgtggtagagagaagctgaataacttgtacaaggattcatacctaatcagtagcagagctcagatttgaacccaggcagcctgtttccagagaccatactttacccaccattctatactgctctgaggtcacagacctccatgatgaactcttaattgagtgcagtcaataggaaactcagataaactcagatgtacaagaaatatctcacttcttcatttgcttttcacctacttaactctgactctgagtccccatccagcttgattggcagaaattgtaatctcagtcattatttggactctccactgcaagggtttttcaaggtcctggaatcttacatggcaccaaagcttggcagagatcctgccagttgtcaatacatactggttaccactgacatgtccattgcagtccagtactctcctgcggccatgtgtagtcctactcaccctcacccatagactgaaaacttccttatattcttgggaaattttctcctttccttttcctgctgccttcaaagacattgataatactatcttcattgagttcaggttttatctacagacagctagatcattctgcaaaatatctctaaggtaagaaattactaagggcctacctaactcacttagatcaaaggggtagagaaagtacagaaagtagacaaagaaattaatatttcaatagattatcctgccacagagtcatagccatgaaaaacaataactttggatttggaatttacctcctacctcaagtttccctctgcaagtgtttggacttgcatgttatggaatgatgattgtaatgaaccatgccttctattggtagcagattttgactgagatataggacagttaacaactgcagtttgaatgcaaaggcagacagagtacactttgcacaagggacaaagaactgatagggaaacaaggacagtctccttttacaccttaaaaatcctcaaataagaacctggcttctgctcagctaaccgacacataagtgcagaaaaaaagacaagattggaatccaaggaaggaaatgttagaatccaagggccaggaatcaaagagaatatatttaaatagaaaccaggttgatactagaactttgggatgcctagagtaggcgggaaaaagatgtatgatctaagcacaggatatttcgaatacaggagcttggataagaagtctatcccaaattccatctgccaccaatgaaagcagaaaggaaatacgtaatgagagccaagccatggggaaatagtccaagatgggtgtgcctcctgtgtatttagtaatcatgtccagctcagcaaatctgagtttctttattccttgagccactgtccattttaatgaacagggaacatttgatctcaagcagcttcagaaactcaattttcccccagcctttgtctaggttttatagaggaaaaggtatagttgcagtactggttgatatttgcttgtgagagctcttgggcaggtaattcttgatcctttgctccacctagtggatttccaggctagagagactctggaaaagagatcagtgatcagaagggtgtacatttgctgataaatgagacttaccagtcagtttctggattatcgtcagtttctggattatcgtctgtttctttactgacgatacccgattccatcccaaagtgtccttgtttgaattgattgaaatctttcatttatttccattaatgccagatgtgtagctgtaagtcatcaaaatctaatgcattccttttctctcttcttaatatataaataacattatataatcaggagacccatatcagcacaagaaagcatattctacttataattatatcctctgagggccaaacacactcaaacctcaacagagtcatttaattaaacaatgacctacctgcttaacactttggggactcctttgaacaataattggttaaagagtcataggaccctttctcaagaagtttcacatccaattataaaaacagatgaaataacactggaaagcagggcgacgctgaaaaatttcaggtagaagagaattcagagctgactcttacacaatatccatatgtggagataaaattagtgttaatgtaggtttaagccattagagttacaacataaatttgacaatctatgcttacttgctggctgaccatgtccctgtcagttaccagccttaaaggctaccaaggcattattctttattccttacctatatttaatacttactttttgttatgggttgaattgtgtcccccaagtattcatatgttgaagtgctaaccctcagtccctcagaatgtgaccttatttggagatagggtctttatagaggtaatcaagttaaaatgaggtcattagggcatctctactccaatatgcctgctatccttataaagaggggaaatttggagacagatgcacacaaaggaagaacaccatatgaagatgaagatggccctctacaggccaaggagaggagcctggaatggattccttcctcacttccctcagaaacaaccaactctgctaatacctcgatattgggttcccagcctccagaactgtgagaagataaatttctgttgcttaagtcacccagtttgaagaactttgaatggcagccctagtgaattagttcaattgcctctggcaaatgaataagaagctcactgcaaaaatgaaattaatccaccgagtgctagagttggacgggatctcagaaaatgtattgcacaatccccttgttttgaaataaatgcccaaggtcacacagcaagttggtgacttagtcactcttttagctcaactttcagtccatcaacgttctatcacagtctgccaactatttcaaagatggtggcaaaatcagccaatgatggtgattagatccaaaacttagttgcaaataatttttcggggaactatatgcaagcataggtccttcctaaatatttgctaatggaagcatgtgctaaataggatgcctaccagaagactgatacccagcagaatagctagacaggtaatttgacctctggctgggcccgtaggattcatcatccctccagacaagcacttggttgtggtaaagatctggctctggttggaaggctgtcccatcccactgagggtgattcaccagagcaacttaatcatctacggatcagaagctcaggttcatgtgagcagggtgggggttaagggaaagagagtctgagtaatgcttcacagtgggtgtggggacttgttataatagtaggcacgctgttgattaaagtacatgacagaagtaattgccagagatcccaaaccagccatcacctagcattagagatgtatctaatatcagacagaaagcctagtttcaactctgcagcagaggcctttgaaaagtctccagaagtaattggcacttaatcaatgcaatcattattacagcacatggctactgcagcttcaggccctcttgcaaccactgaactgcaaaagaggagactatgtctgtagaattttaccaccaacacaacatttgattcacaatctcagactagacaggagtgaacatattttcatatttatatattttagaaatacaggttcactgtcaataagaattcagtcttgtataaatgatggtataaacagggaggggcattttccctttacagaggcttaatcagcattaattttgagagataggaaagcaaaatctaccacaggctgttaagcatttgtttttcatctaatcttctcaaccctccattcaatatttgggggagtatgactgtttatcacttgctgagatatgcaaggtgcacatgctgcttataattaaggaacaaagaaatgttgactttgctcttggtcttgcttcataaagtgttaccactgggcatcaaattgggtgtttaaaggagaatatacctctcttggagagtagacacgatttttaggcctagatcgtctcttcttttccccgcaggagttcgtagttaactttccatcactctgtaaaaggcaattagaaaaaagaaaaagcccaagttcccctcttggcatcttgcagaagtctttcatgcataatggatgagaggaaatggggagaaagaaaagaaacatcctgaaatttaagcacccgtaaatgttttcatagatgttggtagtctatttcagtgtttttcaaaggatattcccagattacccacttcaggataagctgcattgttgacaatgcagattgccaggcctcaatattagacctgaatcagaatttatgggactaggaccctggaatctacattgttagcaagtgtctccagggattcctgtatacactgaaatggagcctactcatctatcttccatagtctaaacagtgctgtgctcagtatctccctccctacacctctcccttgttaatcaaatcaagtctctcatatttaaatgtctttttgtatgcagatggctctcaaatttatatccacagcccacacctcttccctaaaactccagaatcctataccctactgcctgattgacatttaataggcatattcaaaaacaaactcttgaattttctctccaaacttgtccttcttcatctccataaatagcaccatgattaccataaaaccttgaagtcactgttgactgcatccttggcatcttcctcactttctctcatattcatttccaatccatcagagtactgtcagctctactttcaaaatatgccccaaatcttcctctatctcgaagaccagataggaggctgctatcaaaatatgatgttttgattatataatatatattatattatagacttgatatattgtatactcacagctacacatttggcattagtggaaataaatgaaagatttcaatcaattcaaacaaggacacgtcgggatggaatagggtatcgtcagtaaagaaactgacaataatccagaaacgggctggtaagtctcatttatcagctaatgtacacacttctgatagcagcctcttatctggtcccactgcatgttttctgtatcagccagagttcatttgcagataacagaagccattctagctatttgaagcagaaagggattcaaaacagttgtggtagattgatgttacaaaaatccttcctgtttcacccacctttttgcaattgccacaactcccataaagagatgaagtctatttttctctccttgtaaatctgggctagccctcggtttaattctgaccaatggaaagaggcagaactgatgctgtgtcacttccagacctagccttaagaggctttgcggctcccactctcaccctcttagaagaaagcagccgtcctgtaaggaagctcaggctagattactgaatgatgagagaccataggagagagaggtctcagcctttcaaggcatccctgccaaaatcctagacatacgagtgagacaaagtagggccactgacagctgaatacacccacctgcctgtggagccaggcaggatcagcagaattgcccagccaaactaagtttttggggtgcttattacacagcaagagataactgaaatgtcactaaatttagggattgcaaaaccattggagggttggtggggcaggctgtaaatgtggcctccaggaatgactcacagaataacaccacagaactgccctgttagaagaatcgccgctcctaccatagtctgaaagctaaggatcaagaagccatcaaccactttctagcttcagaaacacactatcttagtcatgctctggacatcaggaagtctccacaagtctgttggcttcagaatcataccacagatcaattttagatagcaaaatggataaagtgctgtgaccaccttttccccactgaagtttgttctgaaatcaagacttatgcaaatgcatataactagcaaaaagtaaattatataaacccctagctgcaagagaatctttttagcttttttattttttatgtttattttttgtggcagggtcttgctctgttgcctaggctggaatgcattggtgcaaacatggctcactgcagccttgagcttctgggctcagaccttcctcccacctcagcctcccatgtagttgggaccacatgtgcatgtcaccatgccccgctaatttcttgattttttctagagactggggtctcactttgttgccctgaatggtctcgaactcctgggctcaagcaatcctcctgtcttggactcccaaagtgtgggattaacaggcatgagctaccgcacccagcccacttttagctttttggcctaggcactgtgggtaggcatagaagaaagaatttttttaaaaatgctttgttcactgcgtaacgctcacaatagtgttcacacaaaagagatgctcattaaatatttgttaaatgattgaactaaagtttgataaagcaaaggcataacttagaaatgactgtctctagttcgcccaaagtatgaaattctgtatgcctaaaactctctttcagtaattctcttttatgaatatattctggaatatcaagaaagatctaggattcaggatttttttcagcccaatatttaccatctttactataagtgtacaaccatcccaagtcagacaagctgagtctatttggtttttttttgtaataaattttaattggaaaagatgaatttgggagaatgggaagaaggttttgaagggcaagcccttcagtcatttctgcttcctatggctttggccaccatctcactttgagggcttgttcttcaggatactgacagcttgatttctctgggtaatgtcacacaaaggaaattagctcagtatgtcttctactgaattccatctgtagctcaatgtttgaaggtatttgtgaacatgactacagagcaattttgataagacaaggcaatgttccagtctctgagaatattttccccaaagaactattttttaaaataccactgaacagcctgaaaacccacccacacatgagcaatctcctgcaatatacagaaagcttttcaggtgtcacagccataatagcaggtggttcctttgggtagaaaaattatggcaagaatatagcgacagaaagcaaactgttttgatattctgggtacaactttccccaagtgaatcattcccatatgcctacttttaccacgggcgcctttccagaggaagtgatttgtgtgaacggaggtgtagagatgcattctggtgggtacacttcattggtgcccatatttagcagatccaattaatcgtcagctatttgtcaacccattcctctgtaagtctcaaaatgcaaaattcgaatatgaatttgatacctatttttgctttccacataacaaatacataatcttgttatgaagattcagtagtgctcttttaaggcaaggctgcttctgaaattccatatgaatagatttttaaatacaagcttataaagaaggctgagattagagcaatttgcaaaaggcagtcatttaattcactttttattatgaaatatttgagacatacaaatagcttaaagagcttatttactctgctgtaaacttttgttgcttgtaagataaaaatctggacttgtaaaaaagactttgtttctagatagaacagcaaagttgcaaagtaagagttttgcataatttttttctttctctatagtgtataagactagcatttttattgtttacagataaaccaaatctcccttactgaaaagggagatgttgttgtccccatctcaatttaaaacaaaaatcaactaagctctaataggaaaagatgtgtacaggaagattgctaatggaaaacttttatttttacattttatttgtatttaatttttaaatttttatttgttttatttatttgaatggaagacaactgcattgaaaaataaaaagaaccgggtacggtggctcatgcctgtaatcccagcactttgggaggccgaggtgggtggatcacttgaggtcaggagttcaagaccagctgggccaacatggtgaaacaccgtctctagtaaaaatacaaaaaaattagccgggcattgtggcatgtgcctgtaatcccagctactcaggaggctgaggcaggagaattgcttgaactcaggaggtggaggttgcagtgagctgagatcacgccactgcactccagcctgagcaacagaggaagactccatctcaaaaaaaaaaaaaaaaaaaaaaagaaaaggaaaaaaagaaaaagaaagcacagttattaagctacttaattctgggctttccaaatcttagagtggtgtcatttgctagctgggtgaccacgaacaagttctttaacctctctgtgcctcagtttcctgatctctatggggaggataggatccatcagttaggggttacatgtgaagcacttggaacaatgcctggcacacagtaagccctctatcaatggtaactcattttcttctttaccctcaactagaaagtcagctccacatgacagcagcaattctgtcttgcttagttctgcagcctcagcatctattttgcccatagtaggcactgaataaatattcgttgaactaactggttaatgaaaaataactgggctttgaggttgaaagtcaaaggaaatttctcctaagttttatagctagtgagggaaaaatggacagcagtttagagtcagggaggtagaagaaaaccctaaactaagatgagaagcctgattgaagttcagattcttccaactctctgggtattgcaatcaggattttatttcttaatttgctcatttatttatttacttattattattattttttgagacagggtctcattttgttacccaggctggaatgtagtggcacaatcacagctcactgcatccttgatgtcccagctcaagtgatccttccacctccgcctcctgagtagctggactacaggcacgcgccaccacacctggctaatttttaaaatttttgtagacactaggcctcactttgttgcccaggctggtctcaaactcctggcctcgggtgatcctctggcctcagcctctcaaagggttgggattacggacgtgagccaccatgcctggactctttcttaatttgtaaaatgggaatgatagctcccaaggttattctgaggagtaaatgacactgcatgtgaaagctcttaataaactgtaaaggaatatacaaaagcatgatatagttaatttctatctcagtaagtttttccattggatgacaataaagggattctttgagagtgttggaaaaaggaatctttagctaaagatttcggtactaaaaatattcaaccccagaggtaccacagacatagactaattttttccatctgtgcagtttagggtagatttggcatacgctcaataccaggcaagaaagaaactatggtttaggctgcttttaaagttaaaaaaaaaaaaggcagaaaaggaaactatttccttttataagcaggaatgttaaaatagggaaagctttcatcgagcaattcactactgaatcaaaactatttgatccatattctcacctacctcccctcactccgtatttgtgttgtggttagttgtcttctagatcatggtttatatatcatggtcacttcctcactaaagttaaacaatatagattattcttaaccagccacatgtgactcagaggtcaaaagagtgttctttttgggtaatctctctcaattgctaatacttaaggacctggttttcagaaccattgattatttaaaatgtatgtctttaagattaggctccacccaagatgcctcctcagaggctaagtttgaggttgagaaactagcttaaggagaaagataaagtagcagaaatgtcatggcgggtgagctgatgactcactgccccttccttgaactgcaagaatgacaaaatggaaaaggggaaaaaaaaaggcaatgccctactgcagactagaggctccatgaaacccaagaaattccgagaacttgaagaactacatgggttcttagggtaaaggcagtaagtttaatttccatggtcaaattgttaagtgcatcaaagaaaggacattaggaaagctaaacttgattatactttaccatcagagccatcatcctcaatctgatcattttattctcctgcttaaaaacttcaataactccacattgctactggaccaagtctaaacttacaatcgtatagtagaatattcttcataacatataaccttccttgttaacttcaccttgtaattaattctttttttaaaaaaaatttatttattttttaacttttgagacagggtctcactctgtcacgcaggctggagcggagtggtccaatcatggctcactgcagcctcagcctcctaggctcaagtgatcctcctgccccagcctcccaagtacctgggactacaagcctgtgccatcaccctgggcttatttttgtattttttggtagagatgggttcccactatcttgcccaggctggtctcaaactcctggcctcaagcaatccttcctcctcagcctcccaaagtgctggtattataggtgtgggtcaccatgcctggccgaattaatttttattacatgtcttggaaggtatgggggacaacttagaacttcccaaataagcaagatacttttaaattcccatcaatttgtttacactattccctctgcttaaaactctcatcccagctggcaactcctaactgcttcaaagcctgcctcaagtatcatttcttctcagtagctttctcaattcctatgctctcttgctcaactcccactctctcctgctactcagaatgattgctctttcatctctggagtcatagcactttaagcatgcctttgttaaatcacttaacccaatgaaataaatggactcacagagttctatcctttcctcaacttactgtgtactccctgaaggcaagtgtgagcatgtcattgtacaattcttgccacactattggagaataatacaggtgtgttgaattgaatgaaatattaaaagaggaccaaagaatagatggatcttctaggcctaggaattatactaggagtagaaggtgtatcctaaatccatgtatgtgattctgctttggtcttaccagagtgaatgtaatttgcttttatttaaaaacagtgttgacaggccatgcacagtggctcatgcctgtaatcccagcactttgggaggccaacgcgggagaccacctgaggttaggagttcgagaccagcctaaccaacatggagaaactccatctctactaaaaatacaaaatgagctgggtgtggtggtacgtgcctgtaatcccagctacttgggaggctgaggctggagaattgcttgaacctgggaggcggaggttgtggtgagccaagatcacaccattgcagtccagcctgggcaacaagagtgaaactgcatctaaaaaaaaaaaatcccaaaaacagtgttggattcacactcatgcgtgtaatcccaatactttgggaggccgaggctggtggatcacttgaggccaagagttcaagaccaggctggccaacatggcaaaactccttctactaaaactacaaaaattagccaggcatggtggtgcatgcctgtagtcccagctactcgggggtgctgaggcatgagaatcgcttgaaccctggaggtggaagttgcagtgagctgagatcatgtcactgcactccagcctgggtaacagagcgagaccctctctcaaaaacaaacaaacaaacaaacaaacaaacaaaaaaagccccacaaaccagtgtcatttagccaggtgtggtgcatgcctgtggtcctagctacaggggaggctgaggcaggaggattgcttgagtccaggacttcaaagctgcagtgagctatgatcacaccactgcactccagcctgggcaacaaagcgagaccctgtctctaaagaaaacaacaacaacaacaaaaaaccctcaaaccacactagtgtcatgaatatatttctttagataaaactttattaatcagctttctgtttagaattggctttcccataatccagttaaccaaaggtagttgagtaatttgaaatattccccagctggagtagaatcacatttggggcttgcttcaatcagtgcacctctgtcttgcttttgcttttcagagagaccctaggtcaaccatagcctttgaaggcatgagctgaacggaaaccagatgaactctattgaattttaaatttgccacatttcctagtctagtattaaacttttcttctctagttgagcaagttaaccaaagaagtatatatatattttttctcttatagattatgctcacctaagaacttgaggttacaacacacacacacacacacacacacacccaaaaaaccaaatcgcaaaacaaattattccatactcattccattggttcttttgatggccttctgtcagtgttaatggttggtgtgaaagatttttggaaacgttttccaggagggagtaatagcatttcctgaagcaccttttatcttggtttgtggcaaatgattctttcaatgccctcaggtcacttataccctaagaccctgcatgagtttattcaaccttcaaatcagtcacttctgccctcatctagggcacataacaatgtagttagttacccagcaggtatcgcggctaagtaagaccataaataaatcatatgagcaggagcttttggagtcagtcttctgtctgagcacctctaaccggttatgctaccttaaacaaattacttaacttctctctgtctcacctgatttaccagtttaaaaaaaaaggaataataatggtacctacctcataggtttgttgtgaggagttaaacgtctaaagcacttagaacagtgtctggcatatggtaagtattcaataaacattagccttatattctatactttaagtaccatttatttatatttttacatacaatatgtgggcataacaaaaaattaaaggaagaatggtcatttttagaaaaaactttatttacaaaaccacaactcagtctgctttggtattgacaaaatccctacaactgagatattaaagagatacatttattttagagttacataaaaccagaatccaacactaccctactttcctattcctttgtggctctgaatgcagctttaaaaaaaacaaaacaaagcaaagcaaagcaaaacaaaacagctctttataatgtacaatggcttaagcaaatcgctttagtttttttttctatttaagatttaggacagactactcgtctaaaattcactatttacagagaaggtcctagggaacaggataacttatttaggtttagctctcataatacaatatccataatggctttagaagaatgtaaataaataacattggtaaacagcgtatactgatattttctgacaaactcatttatctaacatcatgctgagcaatcaagaggattcctctatatattttaaattttaatttattctatttcctgattcacaaactcttgctccatgttaaagcagttatcaccaatagaacctatgagaaccagtgcccatggaaacctaacagcttgtttttttaatcccctattaaaactcggttgaacttgatatatgcatggttgaaatatgcgtgggtactaggcctttattcaggaatgtaaaattaatggtatctggtatcaagttgtaagaaaaactcccccagattgggaggtaactgagtgatatgtgaaagaatcttcccgtctgaatttaagaatacacctacactgggcagaaaaaggtgggggagaggaagtagaagtagaggaaaagcacaactccactggcttcaatcaaactgaggtaactaattagagacagaaaataaataaatcaacaaatgccccatttttgttttccaaaaaagatcactggcaactaacaattttaaagttgatccattaatatatttttaaatagaaaaaagtttgtatatcatatatatcataattccatttatctaatacactcctctgctgagatatttaacacatcttcatctgtactctcttctatctctggcaagttgccccgaagtaggacgtttacacctgaaaataaaaagtcataaaattctttaatgcttactactgttataactcagaacacaaattacgaaactttatatgttaatattcttatgtaaaccatagtgttagcagtaaaaagagtagctattgaagaatgtactgcaaataaaattacctaatattatccatctaggacataaactttatttatttattttgagagaaattctctctgtgttgcccaggctggagtgcctggcaggatcacggttcacaatcacagatcactgcagcctgaacctccagggctcaagtgatcctcctacctcagcctcccaagtcacttggactacaggcgtgtactaccacacatggctaattttattttgtagatacaggttcccactatgttgcccaggctagtctcaaactcctgggctcaagcaatcctctctccttgacctcccaaactgttgggattacaggcatgagccaccatgcctggcaaacacttttttttaaagggctaggacataaacattctttaaatccttttaagcaagggcttgaattctagaattttacagctcaaaaggctctcaggagtccatttactcaaactctgcctccagctgcattataacataatcactatacactgataattttctgatctattttaatgatgtttaagaatggagatctcacaagatccttttagattaaatgcctctttggagggttcagggagaagtcctgaataagtctcctcatcccttcaataagcagagaagtagctggtgccatttttctgattcagaaaaaaagcaagggttcggagccagttataatatgaactgcaatccttggtaccagtgggtttcagtccacaggcagagctttaaactgaactttagggccaggttgcagcagtcactataataaacaaaagaataatcaaaaacttcactgagaaagaatagtcagatttcatattgaagaatgaagcacaggtatacagtaaatgactaaacatacagtagaggataatgacaagtttattactctgggcatatattacattattagttaaaagcactaaatggaaaataactgacctctaggatagccaattaacttcacaagaaaagcaaatctttttttttttctttttgagtcggagtctcgctctattgcccaggctggagtcgagtggtgtaatcttggctcactgcaacctctgcctcccaggttcaagtgattctcgtgcctcagcctcccgagtagctgggactacaggcgaatgccaccatgcctgggtaatttttgtatttttagtagagatggggtttcaccacgttggtcagggtggtcttgaactcctgacctcaggtgatccccctcgcctcggcctcccaaagtgctgggattacagatgtgagccaccacacttggccagaaaaacaaatcttaagctgtccagttatcagtgtggacacaaagaggatccagcaattcaggatacccaccccatatacactgagatagcagccacatggcggaatggaatgagccaggatttggagatttggtttgaatccagtgttcaccactgctagtacaccatgcatggttttactacaaatgcatgcaacatagacaatatatattactgtttagtggatttaaattttgtatagaatgttattacactacatattgttttctaatttgctttttcactcgtcatgtttttgaggttaatccatgttaacttgtgtagatttcgttcatttatttttacttctggagagtattccattttgtgaatttttaaaaatgttgcaaatacagcccattgctcatcccttcctcagctgcccatcttgcataggtggttcaaggcgacatgcacagggatgtgtagtgtgacattgttgaaacagtagaaataattaactgtttaccttgactgagggagatactggaatctaatctggcaagaatttagcatgtatctgatgctggtagggatacagatgtgtatcttattattttctataatcttttcgtgtttgaattgtttataatagaaaacgctaccccatccccacccccaccctaagaatgaatggtgttctgctccaggtaaatgtcatggaagagctgacaggaagagctgtaaggaattgcgaggcaaaaatcaaagtgaaaattagaacccataaatgtaaatggagggctgaagccattttgactctgagggcatttgccaatttcaggaaatttgagctgaggtttcccaaggctcctccagaaagttctgggaaatcaggtctctaaatgaagactagcctagaaaacagacctccaggagtccttttcagtttaaacattatagaatttataaggcttgtctatgcattcctttgacactgctggttcaggtgattcaaggacagttgtggcgccattagaaacttgctttgataccaagcatctagaaaatcttgcttgaaatcacaatattagggttacaaagcagaagcttgatattcttggagtcagtactcagagacatgaagcagctcagcacaattggttcaaaggaggaaaaataaactaagagattggatctgacagaagcagcaccttcctttctctgttaagaagggaggaaggaaatcctgtgatacatgtttcttatggattagattcagtgcaaatggaagaatgcggggcttttatctttgaaaaattgaccaatattaaaaagtaaatcaaacttgaaaaatctccaccctgtgttttgaattctgtaaagcaggaaaaatactatcaaagcagaaacttcctttaatgtgtcccatgggcaacacaaatataaaactggagacttaaattaggagactgtatcccacttaggggagttcagataagtccttacatgaaaatggccttcttaacataccaaagttttaaattaagaccccataaatgatagattgagagccacagttgagtcccagataaaaaaatcaaatctacaaaaatctaagcataattggaggatttaaagacccttgacaacctagcttgcaattcgtgatcttttggtctgtgaaggcaaatcatatatttaaaaaatacatttaagttctaaaggagactaaaacatgcatttaggaacctaagaatgctagtgtcaacttagattgtcaagttacttaaagtcggctggcgaggtgtctcaggcctgtaatcccagccctttggaggccaaggtgggcagatcacttgaggacaggagttcgagaccagcctgggcaaaatggcaaaaactggtctctacgaaaaatacaaaaaattagacagggatggtggcacacacctgtggtcccacctattgagaaggctgagatggaagaatggcttgagcctgggaggtcgaggctgcagtgagccaagattgtgccactacactccagcctgggtgacagagcaagaccctgtctccaaaaaaaaaaaaaagttccttaaaatcaacttggtctgttgtgtaaatagatgttagacatggagaacatgtgtcttataacaaaactcaatggctccaggcaatataaaaagtattatataaatcccctttaaaaattggtactttggccggtgcagtggctcacacctgtaatcccagcactttgggaggctgaggtgggcggatcacctgaggtcaggaggtcgagaccagcctgggcaacatggcaaaaccccgtccctactaaaaatacaaaaattagccaggtgtagtggtgcgcacctataatcccagccactcagaaggctgaggcaggagaatcacttgaacccgggaggtggaggttgcggtgagccgagatcacgccactgctctccagcctgggtgacagaatgactccatctcaaaaaaaaaaaaagaaaaaaaaaggtacttcaggccaggcatggtgactcacgtctgtaatcccatgtaatcccagcactttgggaggctgaggcaggcggatcccctgaggtcaggtgttcaagaccagcctgaccaacatggtgaaaccctatctctactaaaaatacaaaaaaattagctgggcgtatgcctgtaatctcgctactcgggaggctgaggcacgagaatcgcttgaacccgggaggcagaggctgccatgagccaagatgacaccattgcacatcagcctgggaaacaagagtgaaactctgtctcaaaaaaaaaaaaaaaaaagaattagtatttcagtgcctcagcaccttaacacaaggaaaaagaattttttttttttaaaagaattggtagtgtactttcttactaaaatattttttttttttttttttttgagacaggatctcactctgttgcccaggctggagtgcagcggtgccacctcggcttactgcaacctccacctcctaggttcaaggggggtttcatcatattggccaggctggtctcgaacccctgacctcaagtgatcatctgtcttggcctcccaaagtgtgggattacaggtgtgagccaccatgcctggccttgctaaaataattagtataggcatacctcaattgtgctttagtttattgtacaccatagatactgggctttatataaatggaaggttttggcaatcctgcattgagtaagtctaacagcatatgcttaccttgtgtctgttacattttcataattctctcaatatttcaacctttttcattattattatatatattatggtgatctgtgatctttgatgttactgttataattgtttcagggtgctatgaaccacacccacttaagaccacacccacttaagactgcaaacttaatcgataaatattttgtgtgttctgactgctccactgaccagctgttctctctctctttcctggggcctccctatttcctaagatacaacaatattgaaattgggccagttaatatccctacaatgacctctaagtgttcaagtgaaagagagtggcatgtctctcactgtaaatcaaaagctagaaatgattaagcatagtgaggaagacatattgaaagctgagacaggctgaaagttgggccttttatgcccaattgttagccaacttgtgactgcaaagaaaagttcttaaaggacataagaagtgctactccagtgaaaacaagaataaaaaagtgaaatagccttattgctgatatggagaaagttttagtgacctagatagaggattaaaccagccatgatattctcttaagcgaaaacctaatccagagctaggtcttaactctctgcaattctatgaagggcaagaaagttgaggaaactgtagaagaaagtttgaagctagcagaggttggtttataaagtttaaggaaagaagccatttctataacatacaagttcaggtgaagcaaaaagtgcagacgtagaagctgcagcaagttatccagaagatctagctaagattatggatgaaggtggctacactaaacaacagatttttcttttcttttctttttttttttttgagatggagtttcacttttgttgcccaggctggagtgcaatggcgtgatcttggctcaccgcaacctccgcctcccgggttcaagccattctcctgccttagcctcccaagtagctgggattataggcatgcgccaccatgcccagctaattttgtatttttagtagagacggggtttctccatgttggtcaggctggtctcgaactcccaacctcaggtgatctgcccgcttcggcctcccaaactgctgggattacaggcgtgagccaccgcgcccggcctcttattcctttttttttttcagatggagtttcactcttggtgcaatggtgcgatctcggctcacttcaaactccacctcctgggttcaagtgattcttctgcctcagtcccccaagtagctgggcatgtaccaccacgcccagctaattttttatttttagtagaggcagagttctactatattggtcaggctggtcttaaactcctgacctcaggtgatccatccacctcggcctcccaaagtcctgggattataggcgtgaaccactgcatccggcagagatttttaatatacacaaaacagccttctattggaaggagatgccatctaggactttcatagctagagaggagaagtaatacttggcttcaaagcttcaaaggacaggctgaatctcttgttagaggataatgcagctggtgactttaagttgaatccaatgctcatttactgttccgaaatttctagggttcttaggaattatgccaaatatactttgcctgtgcgctgtcaatgaaacaacaaagcctggacgacagcaaatctgtttacagcatgttttactaactattttaagcccattgttaagacctactgctcagaaaaatccctttgaaaatattactgttcattgacaatgcacctagtcactcaagagctctgatggcattgtacaaggagataaatattgctttaatgccttaacataacatctatttggcagcccatggatcaagaagtaatttaatctttcaagtcttattatttaagagatagatttcataaggctatagctgccatagatagtaattcttctgatggatctgggcaaagtacattgaaaacctggaaaagcacattcctgattcatgggaggaggtcaaaatatcagtcttaacaggagtttgaaagaagttgattccaaccctcatgggtaactttgagaggttttagacttcagtggaggaagtaactgcagatgtggtagaaatagcaagaaaactacacttagaaatggagcctgaagacgtgactgcattgctgcaatctcatgatgaaactttaatggatgaagagttgctttttatggatgagcaaagaaaatggtttcttgaggtgaaatctactcttgatgaagatgctgtaaatattgttgaaatgaaaacaaaggatttagaatattacataaacatagttggtaaagtagtaacagaatttgagaggattgactccaattttgaaagaggttctactatgtgtaaaattctatcaaatggcatcacatgctacagagaaatcttttgtgaaaggaagagtcaatccatgcggcaaacctcattgttgtcttattttaagaaactgccacagccatcctaacctccagcaaccaccaccctgatcagtttgcagtcatcaacatcaaggcaagaccctccaccagcaaaaagattatgacttgctgaaggttcagatgatcattagcagtttttagcaataaagcatttttttttttcttttttgagacagggtctcatattgttgcccaggctgaaatgcactggcatgatcacagctcactgcagcctctacctcccaaattcaagtgatcctcccacctcagcctcctgggtagctgggacgatagtatgccccacgatgcctggataatttttgtattttttttgtagagatgaggtctcagcatgctgcccaggctggtctcaaactcctgggctcaagtgatcctcccgccttggactaccaaagtgctgggattacaggcatgagccactgctctcggccgaataagtattttttgattaaggtatgcacattgttttttaaatgtcctgctattgcacacttaatagactacaatatattgtaaacataacttttatacacactgggaaaccaaaaaattgtgtgacttgctttaattgtgatatttgcttgctttattatggtggtctggaattgaacctacaatatctccacttgtgcctgtacaacatactttatactttggtgtcaaatatttcccttgactaaaattctgtcataacgtattaacatagatgtcgaaatgtctgtttttattctgaagcatcaccaaatacagaggttacttagtcctcctcctctcaactcccattgccctaggcctggcctctccctttcttacacacacacacagacacacacatgcattagactatcaaatctaaaatcttcaaaaattctctggagtcagaatatgtatcaaggcagcagttaagagcaattataatattcattttaaaagaccaagaaattcagccaagtttgaggccttaagtacaaggatgaacatagaaatgacaatgaattttgcctaatagttttcataagtgaatgtctgggaaaaaagaattgaagtttcactctagctaatccagctaagaagatctaaaaggaatcctgaaatgatctattgggaattttactcaggtattgatagagaaatgttacaggaatgtccaagtcaattgtttcttacctgtggagtctagtctgttaatatcataaactgcctggctgtgaaacatccagaagtgtctgttgttgcaggaaagaagacaggaactacatggaacaatcacatgataaactacaatgttcccactagaaaagaaagtaaatgttactagataccatgtaataactagccagataagtcttttcatattgcttatataaatagaccatataatttagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctagaataactttttttctctcagtactttaggatgttgccacttcgacgctttgtcattgacatatctttcctgtttttgtaaacttggcataaagtgggtttcctgtacttgttatatgatttttggattgtgtattcaaattaaaagtattaaattaaaattaaaatggcctgggtgaggtggctcacacctgtaatcccagcactttgggaaggggaggcagaggatcgcttgagacccagagttggagaccaccctgggcaagatagcaagaccctgtgtgtgtgtgtgtgtgtgtgtgtgtgtgtgtgtacacataaatatgtatatatattatatgtatgtatgtatatataagtcctacagtcaccttaagttccaccaacagtgcgcttaaggtaaaatgtgcccaacctgaggctcaaacctacctgctggcacgcaatttgtgtttgtgcgacaatctcaacagcatttgctttttctagcatagtggttttcctgttttcctcacatgtgaatgtcttcagtgcaaaacctgtcagaattcatttcctttgctaaaatgttttaaaataactcttacttcaagtaagtgcattaaaaataaacttctcagttgcatccctggaatccatggaaagtccaggagagacaatcaagtgctacaggatcaagcccaaacagaacaggactaggcatggcttccccactaggagccaggccaaagtcatctcctttggtctccaatggaggccagaactcggttcacctgcaacgggaggacctggcccagaagaggtggccttcatcttcatggtgccttcagataggaaatctaggatttcttttcttctctttcatctacttccaactctccctatttatttatttatttatttatttgagacagagtcttgctgtgttgcccaggctagagtgcagcggggcagtctcagctcactgcacctccgcctcctgggttctagattctcctgcctcagcctcctgagtagctgggattacaggcgcccgtcaccgcgcccggctacttgttgtatttttagtagagacagggcttcaccatcttggacaggctggtctcgaactcgtgacctcgtgatccacccacctcggcctcccaaagtgctgggattacaagcgtgagccaccgcatctggccctccctttctatttcttcaagacctttttctgatccctcctgcgcaggacctaaacgggcggtgcccttacccactggtccctccctgcctgctgtcttcggagccctagctcacccggaacgttactgcccgccggtgacagcgagaggaccaaagagggcagtgggtgcggtgggaaccacagagtcaccgcgcacctgcgcctcgcgggctcctcgcaaattgaataaacgccccctgaagcttctcttcaagtcacagggaaggggaaggtggctgccgacccggcgggagaagccggccctgcccctggtccttgaagacaggtttggccaggctgattttgactggtaggcccaaagaaaagcctcaagggcagaccaaactccgacaggctccgagattaaggctttcaaacgtctgatcgttttcagcttggtcagtaaaatcgatctcgcctttatcaggagattcctttgccaaagttcagagagctggggttccagctgcttgccacacagaaaaccaatcactgagacggttattgccaaggaagaggctttaatagggtgctgcagcggaggagatgagaactcagtctcaaatccatctccctgaccaaccaaaactagaggcttagatggcagggaaagaatgtgacaatgtgtaagaaaacaggaactagaccaggcgcggtggctcacgcctgtaatcccagcactttgggaggccgaggcgggcggatcacgaggtcaggagatcgagaccatcctggctaacaaggtgaaaccccgtctctactagaaatacgaaaagaaattagccgggcttggtggcgggcgcctgtagtcccagctactcgggaggctgaggcaggagaatggcgtgaacccgggaggcggagcttgcagtgagccaagatagcgccactgcactccagcctgggaggcagagggagactctgtctcaaaaagaaaaaaaaagaaaaaagaaaagaaagaaaacaggaactagggaggggcaaggaagcaatcaggatgaatgaggggtccggcatctcattgtctgggtgactttcagttctttgatatcttttttgagaggcctgaaggaaggaactcaaataaaacaaatatcgagtttcaaactttcagatcagaagggtccatttctatgtttatccaaaaatctacgtattggactattgggtgggtttcagaccaagaaagagtgtgcatatcaaagtctgcggttaaccaaagagaaaacataattttccgaccaataggatgtatgggggtcaaagaacgaccagcctacagtactgtttattggcctgagcatacggaaggatgaagttgcaccagcgaaatgggattaagctgcaggtgcgggctgggcgcggtagctcacacctgtaatcccagcactctgggaggctgaggtgggtggatcacttgagatcaggggtttgagaccagcctgaccaacatggtgaaacctcgtctctaataaaaatacaaaaattagccgggcttcatggcgggcacctgtagtcccagctactagggaggccgaggcaggagaattgcttgaacccgggagatggaggttttaacgagccgaaattgcgccactgccctccagcccgagcaacagaccgagaccccttctcaagcaaaaataaaaacaaaaagctgcaggtggaaaaaaaagtctggattttggttcagagcccctggggccttcctcagtagttttctctttctttgaaaaaggaagcctgtctcagtctctgcatctctctgagtccttttggagattgaggatggtgaggtctcagtgcttggcccccttctaactctgggtacctcccctcccgtggtcaaactggtccagtgcacaggccccagctccgacgaccatctcccccctaccctttgctcccagcaaaggccatttctaggtcagtcgtgaggtacagccaggacagggcagctcgctccgagatttttggctctcgaaggccttgagcgctgtggttctgcagaacgctgtctgcctcttgtggaggaactgacacccgctggagaaagtgtggagggaagcgagggctgcacctgcacgcaggatctgaggcaagcggctgttcccagctctcagtgcaaaagacatttgtcatctgagaggctggactcagttattataattttcaattttgtcaataaaaaccgaatggaaatttgttttcttacttgtagaaacctcctcacaagacctcccatcttacattccagggagaattagcagggtattccgccaagacataggttagactgcggttctgatctgcaggcctcgatgccctgcgccagggcaccagggcatgggcaaagccctccccctacacaaagcaagggtgttatgtctacaaccgaacggggacactaagagcccccaacatgcacggttttcattccaaagaaaaccaccagttctgagtacaacttccacctggctctattaactgagtacacgtttccccagcacagaaatcctacaaactcccgtgaatgctgtggtgaaaagcaggagctgccagggcaagatggatcgcacctgtaatcccagcacttcagaaggctgggcggaccacttgagcccaggagttggagcccagcctgagcagaatggtgaaaccgctacgaaaaaagaaaaagaaaggaaagagaaagaaaagaaaagaaaaaaaaagagaaaaaactagccgggtgtggtggcgtgtggttgtcctactcgggagcctgagatgggaagatcgcgccacttctccagcctggacggtacagcgagacttgtcttagggagggggggaaaaaaacaacaaaaaaaccagaggctaagaggtaactccgaggatgacagaaaacaccagagtttttaagagatgttagaagccctgggagcactgaacaaaccagaaagctcccgacccttgatccctgagctccacctagcaagtaccgcggcagctaacctgggagaacaccccaaccaacagagactgaaattcgcctcccaagagagtaagtggatagttctaagctgtccccaaacatggcctcacaaacgaaaactaaccgttgcgaacggaaacaactgaccggacagaacacagccacaaaacacgagcccgcacactgaattacaaaaacacttacggctcacctactattcgcaccacaaaagcaccagaggaaagcgcgaacgcagtcccccactaccacaaattatgcagtcgagtttcccacgtttggggaaatcgcagaggtcagcacatccggaacacaatggataagcctcgccctgagaaaaaccaccttcgtttgataatagtatctcccctgccaggtaagtatgagcttttgcacctccgccccgccacagcctcacacgcttcaccctttacacgcacggtcacttgccccgcgcacccccccccccccccccagccctcctagccctgacacacagctgggactctcaggtccgaccagcggtcctgaacccactcccactgcacgggaactccttagtggcgaagcagcagcccctgcgctgcctcatctacatagaaatcgccctatccgtgatgtcaccgacagcgcctttcccagtccccgtctgctcttccgccccaccctccgccgactcagccgatcaacccgctgccggagctggcgaaggaagtgacgtctgtctctttctccttttcctcctgccattgtcctttggggaggtgcgcagagaccccgcgtctggtctccccctaagactgtggtacttgatctgtgtcctgcagagaacccttctggtggccaacaggaagcttttgcacccttcttcagataatgtcttttaatgcgcagacttgaacgtttaggattacaaggaaaaccggttcctttcaaacctgtttatctttgtgatgtagcattccgcttcaagttgaaagccgttcaatgtcagagagaaaacatatctatgaaaccagagaggctgctcagatgggttgcaaactagccatccttactggttttaccactagaagtgttacaaagacagttgtccaattttatgaatcttgaagggttttttgttgttgttgttatttcaaatacagtgtaatacaaaaatatgtggcccccgcagagacgattggacactctcaggcatggtgatggagtttgtcatctcttccacggccatctcagaaccttagtgcttacctcatattagtattttatattctccaaagacacaaaaataatcccaatttgacaaaacaaacaagcaaaaaaacatctagggcatgtcttatttgaggcgcttaacaaatgactggatcatctcccttgtatataacccagaaaacactgtgaagtagagcaaaattggaaagcccaagtcaaagaccatttgcaaatttcaagtagattccagtctgttgctcaaatcacaaaacatgaaatggaggggtctcccttggagaccataaagtctgtgacatggtggccagttgggtcactggaaaacatggcaaaatattgaaaatgagggattaggtgagagtgtagcaactgaacactaaatgcttgatccaggtgccattccctggatactgacaggtaatactggaaaaagggggtgggcacagtggctcatgcctgtaatcccagcactccctcaggaggctggcagattgcctgagtccaggagtttgagaccagcctgggaaacatggtgaaaccccatctctacaaaaaaaaaaaaaaaaattagccaggcatggtggtgagcacctgtggcccagctactcaggaggctgaggtgggaggattacttgagcctgggaggtgaaggttgcagtgacccaagcttacaacactgcacttcagcctggatgacagaggaatgggccttcactagacactgaacctgctggcaacttgatcttggactgaccatcctccataactgtgagcaataaatttttgttgtttataagttactcactctgtggtattttgttatagcagcacaactggattaggacatcaacctgaccttaagaaatcatctcaattcagtcttggctctggtgggaaacaagggacacactcggatgtgtgatttaaagagagttgtgtttttttttttttttttttttttgagatggagtctcgctctgctgcccaggctggagtgcagtggtgccatctcggctcactgcaagctccgcctcccaggttcacgccattctcctgcctcagcctcccgagtagctgggactacaggcgcccgctaccacacccggctaattttttgtatttttagtagagagcgggtttcaccacgttggccaggatggtctcgatctcttgacctcccaaagtgctggtattacaggcgtgagccaccgcgcctggcctaaagagagttttatgaagagaatatttataaatataatatggacaggatcaaaacaacccaaccaaggactgagaggcgctcagaatctggaatcagcagagaagttgtattgcctctaggactggattgttgtataagtctgttcaggttgccataacaacctggacaggaccgtagtcctgtccagtgatcctccccaagacaaccgttctctctagtaactatggttttcctttctcatttcaattgtcacctcaattgactgaaatgtgaacaccaactcccgcacttaaatgttgaagccctaacacctactgtgatgatttatgcagctggggcctttgagaggtaatcaggattaaaagaggttatgagagtggtgtcctcatgctgagattaatgccattacaagaagagagacactagaaagcttgcttgtccgccttccccctggtgcacgaagaaatggtcacatgggcacacagtgaatctacagccacttacaggccataggaagagaccttagaaagaaatccactttgctaccacctttatcttggacttcccaacttccagaagtgtgagaaatacacttctatagtttaagccacttggtgtatggtatcttgttatggcaacctgaacagacttatacaacaattaagttgcctttccactgatggacttagacacaatctctttcccaaaaaagagctatatttagctacttttcttttgcatattgttccatttgcagccacactatttgtcttcccccacaccacttctatcaccaggaatccattttccttgttttctttttaatatcgggagcctctgctcactgcactgcatagtccttggggctttttttaaactttatttttaacaatcatttgagcagaaagtagccaattcagttctttaatttcccattttattcttggtttgaaactgacctgattgtgtcccttttgttatgaccagttacttagaagccatacagcccacaaggtacccttgggtataaatccaacttcttcattttaatggtgagaaatcaaaagcccacgtttcctgatttctagcccagcactggaactgttttcatggcatgtcaattcatcatacattttaatagtgatattttatatttgcataattttattgcctttgcaatgggctttcacatctatcttctcatgtgtatatagtttaaaggccatttttacccactatctcctaatcatatcgaccacagcctcaggaaatgtctgctctattatttcacttgcctgtctgggttcttgggcaacagcatagaatcctgtactgtgttttccctcacgctttctcactctctgcagaacaaatttttgttacatgccttattatcatggtaatattggccttcagtcctgtatagaagcattaaaaatgtgcataatgtatatccttttaaaatgttatcctaagaagcatcttttggagttaaggagagttagatgaataaagaaagaatacagtttctcctaaacaaacccactaagaaaatcatggaaagaattatgacaactatgaaaatgaaggaggtatactttgtcaacaaaagcaaaataaccaagctactcttagacataatctcacattatctttctgtagtgctctagcattttctaagccttttcacacactgttatctctttttttctttctccttctagaaattaattatgacttttcctttcaaaaatgaaggactttttttttttttttactcttttcattttttcctgagaccatatgtcaaagggaatgtgaggaacaactttggtgtggtaatagccaaatttctccaggtctgctcctcaagcttgcaaagtcaagactggcagaagtggtgatttttacctgggtatcctgagaaccttgcacagtccttatcacatgcaggtgttcagagtgtgcaaataaatgaagaaatgtgagattgtgatgatattttcatggcatgctttttttccacacttcctcatgcagcccaacatcctctacactgtgttgttctacccgtttaagtgatttaccacttctccattaagccaacttaaaccatgttgccttcaactcaacattgattgatccccaatacagtcctgtagggaggcaagaaaacttacaaacgaagtggtaaagaaagagagagattaagcaatttgccccaaatctcataaccactaggtgataaatcttcaactagaactcaaatatctggctgagaattcagtgctcttttcatttaaatcacattgcttcataaaaatagatctgcaggaagaataaaaatgtccaaagtgcaatgagagagaagataatatggagacagacatattgcacagaaagcatttgaccatatgtctgcctgatccccttcatgtgtcttgttcataacttactttactcgggcagcaggagatagcataacaactgtcagagtgaatttaggccacagttttgtgttgctgaatgtgttgagtcatttcccttagttcacatttctacctaactttatcttttaagtcatcatcatgcctttaatctcttatttattttgactgttgagattttgtagccattatccaaataaaacatttattttcactcgtgagtccctaatccttcctcaatggaattagctatttatttgatgcaatagctagaccagtagggttaaaaatgcttttataaagacattaatagctgggtatggtgatatgcacctagggaggctatggcaggaagatcacttgagtccatgagtttgaggccaatgccttcgcaacatagtgagaccctgtctttaaagtaaaaatttaaaaattaaaagaaaagacatttaaaaaggctgtttaccaaaatgatggttaattgacagaaaatagaaactgaaactagaaatcattgccatcagctttctctaatgtgtacttgatccttttctccctgtgatggaagtctaaagtctttttgtttttttcttaatccactactgttcaaatgagaataaacagccaaatgactgaattagttggtagacataattcctagtcttcaattatttttattttcttttgtaatacagtcattattttttcagacttctataatattgcatttaaccaatccccaaatagggaaatgttatgtaatttttctattatttacagttccttgattataatcttttatttgaaaagattatatatttatataaaaacccagtttctttcttacatataaatattattagtagtctaaaaatgtcactctcaataaacaggatgagtcaacttgaggactagagaatcaggtagtcaacatcagagaactggtttagcaaacagaaggggcctatccagatagagagaagtcaggcagggctgtgctgtgaaaatattagagaagcttgatgggaggcctaatatagtttgtctttacacctgtatattttgcttcttgcatctgcttcaatgccctctgtcatttattataactagatttattgttccaatagatttgtactacagtcagaacaaacaaatcactggatccagcagaagccttagatatatgacataacagagatttgcacaaagatttgccccattgccttctcgaatttctcttatcatcaatccatctagctggagctctctgaaggtcatcagaggtcagtataattttaataagattttaactgaaggatagccttgatgttcagtgaccttcagacatgtttataatcgagaagccactccccctgttgaatgataacctcttccatgaattaccaaaccaatgttgctcacattctgattaaccattgattcccataaacccagcttcccccaacactgatgatctaaataacctgaattatttgcattgccttatcaattccatctcatttcctgtcttggtggttttgctcacactgcttctatgtggaatgtccgtatgtagccactcgagtttccacttcatcgttccatcatctgtagtctctatacactatccatcatcaggactaatgtgagctgactttcctccaaaaagctttccctgaacttatcctgaaataacgtttttctctgctaacttaccatttgtcacgttagtatacagcttctctaactgtcatgaaatgaaataaatgggaagaagatgaaacttgaaaagaaatctgcttcttaaggcaggccctgggggaatagccctggctggaggtaatgtaaggtctagatggtgtttttagaatctgaagactgcaacaccaaacacaagtataagcctaggcaagctgtcagtgcagggcctaaaattaggtatttcaacaagtggatgaatcaatttggggaattgtattagtaaacagaggaagcccgtccagtaaaagggagagtaagcagggatgcaatttaaaactattgaggaaaaaatggctaagaaatagtaaaattaacacatggcctaaaatattaagaaattaagcctgttacagaattactgacctggctagtatataggagcattaacaacacaaaaacagattaggtcgggattagcagtgggggtgaaataatcttcagggctgaactactgagctagaaatatttaaatcctccttgcagatgagaactatagaggacaatttattggttcagcatgaatttctggtcttctgttaagaaatacgctctttcattgaaagtgaacattgaggcagtaaactccaaatacagctgcaggtactatctcctgctgatttgtgtgtacagagcatgaaagaaaggctcagaaacaaaagcatgttggaaaaataagcagaaggaggcatttacttgcaaagaaatgtgaggaagtcattcttcaaaagaactgcccaaaaaattaaaaaaatagaactttttaagacaaacaatattatgaagactatagggtttatattaatctcttcatggcagaaaacagcaattttatcatggttattgtattcagaaagttcatgacatatcttcagacaataaacagctttgtaaagtcaaggataaagtgattttcattaaggagttagcaactctcaggaaatgctcaaggttttattcatttggaggactgcaggtagacagagagacccttttattgtttctttatgtcagagtgcagagtttttttttctctgtttcttcagcagtgggacatgatgaatgggctgacaatggtgtcaggccccgatgtcactttggtttttacacttcatcttgcggtcatgtttccttctctacaggacatgtttgtctacctccatttgctgaacaatgttcttaatcagtactattgattttacattttaatttgatccattttatttgcacagatctaagaagtgttgattaatatttaatgacctcctagtatttttttgatgaaacaataaactaaggctcacaagtttacgtctttctatagatttataaagcccttgtggattaaatttacttttacatgtttaacagctcagtttagagcagaccaaaccagtccgttcacctctacctgatttcatctgcagtatttataatgcaaatgtatcctttttaataaaagatatccaatgtctcggtgtccctgctctgccaagaaaggacattctttcttacctccaagcctgagattgcatagtccatagagcaagcaccagatttgtttcctagaaggatgttataggcatcgcttctgcgtgaaaaacatagaaattattcttattactggatttgtcttgtctaattaaattgaatttgtagcacagctataaattttttattaaaaaattgattcttcctggctgggcaaggtggctcatgcctgtaatcccagcattttgaaaggctgaggccggcagatcacctgaggtcaggagtttaagaccagccaggccaacatggtgaaaccccgtctctataaaaatacaaatagtagcctagcatgatggtgggtgcctgtaatcccagctacctgggaggctgaggtgggagaagtgcttgagcccaagattgagaggttgcagtgagttgagatcacgtcattgcactccagcctgggcaacagagcaagactccatctcaaaaaaaaaaaaaaaatttctaattagtaatatattcaggtagaagggaggacaaattcttattgaaccaatataaataactacatagtcacaaaaagtaaatgtttttattaaagaaactttgtgcaagatttaaccaatattgctaattaagggtatgttaatagacaaaaccaaatattgtatgtcacaattctttacaaaataattatttgtatgtttttcttggcaacttattagctttgtttttatattaagaatttctgcaaggtattttttccctcaacactaagaattcagagtgttttatttagtttttacaaatttaataatttgtaaatttaattggagattaaaggtagattaagaagaaagaaaatgggttgttctcatgttcattaaagtagaaaattaaactaacctcaattaaattgccttactgaggccctttaatcctaaataacaacctcttgtcgtgctggtcttgagttaagcagtctactttcatgaattcatccgcttctacattgtgagtgtcttggaactcctgactcatttacttcgtatagttggaatattgtctgtggggacaaggtcagcctattcttggaggcctatatccatgagtcaatttcctgtggtatcaatagtatcaacagtgtctgctaccgttattactggagctcttttgatatttcttccagatgactcaaattctgattggcgctttgtagagaggcctttaggtatgcttaaagggaaaggagggctgggcacagtggctcatgtctgtaatcccaacactttaggaggctgaggcagacagatcacttgaggtctggagtttgagaccagcctggccaacatggtgaaaccctgtgtctactgaaaatggaaaaattagccatgcatggtggcgggcacctgaatatagctactcgggaggctgaggtaggaggacagcttgaacccgagaggtagagtttgcagtgagctgaggtcataccactgcactccagcctgggcaacagagcgagattccatcttaaaaaaaaaaaaaaaaaaaaagcagcggggatagggggaggagatgttgctaataataaaactgtaaagtttggttaattttttgccatagcaaacgacatcacaatgggggacagtggcattctctgttgaggtgtaatacatactcatctaatgaaattttaatcagtgattaccgtaaaagacagaacacatgaagaacaattagtgcatcccgatacctctccagggcctttaattttccccacaaagtagatattattatttgtcaccaactgataagtttactttttttaatcagttggttgacatttattgcaccagtctttgtacatgaacataaatatgcctgaatccaacctgagaagtgcacaattattgtaacatagccacagtaatcatacataattattgcatttaattaatttaagatgattttattgctattttctcagaatatggccttgaaaaacacagcagcttccactatattgagcatagttttgagccaattaaatatctggagaatgcaaaacattacctttatttctaatatatcttcatgttaagagctaggaggaggatctctggagtttcccagcagccatctgagaaacccagagatactgtattcataaataacatctcagtagttttactattttggatttgagggttaaatttggggaatatggtatcaaaaacagtgtcacaggtgggggctgcagatgtgaagggcctgctatcaatcaggtgaccctggatggactacccactcgctgtgtcagtccaggatcccagctgtagtgggttcctctctgctacagcacatgtttctaaagggcaagaatctgggctcccaataactgacctctgtctcctccatcctggcttgtcatgatagacccgaaccaccctcccattgaatttgggcccttgtggctcatagccacaagggaaattgggagctcacatgtgaaaggcagaattaagttaacgcaccttcttccaaagtcttacgtttgtttgtagcccaggtgcccctgtttccagcaggagtattagcagtaccaggcagccactccccagagtttgtgtttctgagctttcccatcatcagttaattggaaatttcaggaactgtccctgccttacaatgcctgctctgatctacaggtcttttggagacagacagcaggtgatggggcatgccaaagagataaaaatgtcttctgataatcaggggtcagcagatgagtatgaaagctaattatccccactactcagggaatttagaggcttccccttttgtctttgtaggaatagcagactttctgactgtaatgtccaaagttctttacaagttgaagtacagaagagatcagaaaatgtcttacgcacatgagagttgttatccaaagatttgtcataggagcagcgactctaggtgttctctattctatttagaagaattacattagattttgattcctcaatgtggccaagaaatagagctacttgctgggagcaagaaagataacatgacttctgaaaactatttattatgaaaaatgaattttcattatgtagcaaattacactgcagaagtattacaaagaattctcatagacatggtatattaaatctcaaatcaataatcatacatagtcaattaaaaatatctttgttgatatctttcagaacctgggaaataattttctgactttcaaattttttagtttctattcagtggcagaaaatctatattgtgccaaaccagtctgaaaattagtagttgattatatgctggacacagaaaaattttctataacctgttaaatgcaacactccattcattgcttaattctccccaaatagcataaggtaattaaggcttttgtaaacttttttctttttttagaacagcctacagtgacagaggagaatggttatattgttaattaaagctggttcatcactcatgtggtaaacctgactcacatggaaacttaactattttatcacaaagataaatgtttatcatttaaatatgtatgtattcacttttatacttcttgaaaggatttctaggagtacaaagtaaactactataaatctcttttctcccggatggcaatattgctgtgggtgagaaacaatttagtccaggagagctatatctaatccggtaggacactgtggagaatacaagtgttaaatttttgctaaaaaactaatatatggccgggagtggtggctcacgcctgtaatcccaacacttcgggaggccgaggagggtggatcacctgaggtcaggggttcgagaccagcctggccaacatggtgaaatcccatttctactaaaaatacaaaaattagccaggcatggtggcaggcgcctgtaatcccagctactcaggaggctgaggcaggagaatcactggaacccgggaggcagaggctgcagtgagccaagatggcgccattgcactccagcctgagggacaagagcaagactttgtctcaaaaaaaaaaaaaaggctaatatatggagattgatttattattttatcaaaaaggtgacccaaatactaatatgacttttttgagaccatccatttaacaaattgactaaaagactcaaaagttcttttatgttttatgcccaaactaattaacattgagtaaagttagtccaaaaattataaacgttttattgctcatttaaactcattatttgcagctattataagctatagcaaatgaagtttacttccctcagatattctacaattattgtatgcccttaaatttgtattttaaaattcagttttatattctagcaaaactctacaatttgccttttagacaaaattactctctttgccttgataagcaaaaacacattaattatattgcatgcacttttctaaatactcaaactgacttaatttcttaaagtagtataaaagaacatgtgcattaatcagaactaagggtacttttacatactgttcattctcctacttgatagccactctataatgtgtaaaaatatgcagcaaggatatgttaaaaattttatgagacttatccaaagatttttcactaattatctcaatgaaatattagccaagctcataaagctaactagtatgttaaaattcattttaaactgacacactgcagagaatttatactaaaatataaaaatttacatgaaaattgtgttacatatgaaatttgaattttttaccaggtagggtatgtgtggttttacctatacagtataattatttgtagccccatctcaagttacaggaacaaatgttttaaaaaatactagtttaataattcaattcagctgaaccttaaatcgagtaggggacatctagaaagctctggtaagttaaaatattttataaaccagaaaaatatgctaacattaattctaagattgtgataaaatcagagaaaaaacataattaatttaaaccaaaattatcaaaccatatacatttatccaaggatttcccatgattaaaaatattactgaactttacttcagtcaaatttttgaaacgcttcaattttgttctgaagcactgaagtcctttgcgttatgcgattctcttacccgcctgccttcccttgcttctcgccttctgacatagcaacaaagtccattaattcacctcagaactaaacctctctatagattttttcttctgagctgcagttcagcaagttacctgtgctagtatacataagccaaggaaaacagaagctccattaaacttaagaaattgtttaacctaactcattaattttctccagagataggaaaatgtacaataatttgttcagaagatatttacatacatacaacaagaagtcattatcaaattcggagccagtgatgattttctccctgctttattgtagactttcatatgctatttatttatagtccttatccagtcagattatagattatggtagagacgtaatttttgaggttgagtaatactttactgttgatgtatagaatattcctcacaacttattttaactcatttttatatttctatgagattttccttgtttggggttttttgtttgtttgagaaaagggctagagaaatttaaatgcttgaaaacctttagagttttcagaagcacccagaacttcaaagaaacacaaagctattctcattaatgctttcttaagacaaataaagcaaagccctaccaacagttagagctctccatttttcaagctatgcaagattgtctccaatagttatggcttcagcagtggttcaacttgagtgtgcatcagaaccacctgcaaagcctaattaaacggattccttggctcacttggcagtatatgactcagtaggtaagatttgagaatttgcatatctaacaagttgccgggtaatactgataccgatgtctagggactatgagaatcactaacctagagtgtttaaaaaatgaccaatttctgtgcccaattatctgccaaagtttcctaagagaaggaaaacaacaacaaacaaacaaaccaaaacagagagaaactgagagaaacagccacaactggaaactagtaacacaaaaacaaaccattgtaaaagctaattaacttattttcataccaatggggaaagatttttatttcattttggacccacaaaaagctttaggagttttttcatgtgccagaaggaagcacataacctccaaattcacaatctattctttgcccgtttgctgtagttactcttcgtaccaaaggttctgagtctggagtctctgcttccactggtcagatagactttctccttacattgtggtctctcactgaatgttctcacccactgcttcctcactacgtaatatctgcccaagaagctcccgtcttctcattctcccatcccatatgctgacattctttccagtccctgcattgttatgagagctcagtgggggagggagctgaatgtctgtattcagtccacaactacgatctaggatactctgtattaaccataaataattgatgcaagtttcttccactcagccatagctgagccagattacccgcaatgctatctcatcccaccacagtctctacgactaatttctattatgcaaggtaagatcaacatttgaagtgattgagtttaaacataaaaagatgtattggctcctgtgactgggcagtcttcagggttagttgcttgagtgatcaatgataccattaagattatgattgggacatgaaaaaaagaactggcaaataaggagagaactttgaccatagaaaggcatttaatccttgtgttgttttgagcgccctaaaggaaaagacaaattaaaggcagatcctaacagaactattaacaaagaaggaagagggtgaatgagactcttgaatcaaaaattcttaattcttaactccacctgtgaaatcttacttaatctggttatactaagaataatcatcacaccattctgtctcacattctagaaggctttgtagtggtagaactgtaaacaatatataaacatttctgaaatattgtggttgttttatcttccataagcctcacacaagccgtgtgtatgatcatccatcttctgggccattatctgattattgctgctatctctcgctttggggaaaggagagtctctttccttatcaatagtattggatcagctcttctaatttcatgatgacatgagtgttcaggaatgatggaaggcaaatgtaactctgagaaaactttgtttaactactgcatttcacaagtccatatccatcctagaagatcttccagcctgctctctgccttgctcccaagatggccacatgtaggtctcttctttcccgtaaccagagggttatagattatattatctttcaaagtctgggataaaccaatttctcactctaaagagaacaacgtgttttgatttttccaaccctaaccctagcctaaagtctaccttctaatcctatctttattataaatgtccctggattgatctttcaagggatttttgcctactgaaaaaatattactctcactcaaagaattgtggcctgacaagaaatctacaagagtcttggacacagaggccaaaacatcataacgtctggattattcaggctaaagtaatatcacctgtgggttacccacagcccagtcctcagcttcagacaatgccggagtcactagtgttctgttttctttcctctatcattcctattcaaaaattctaaaaatttggagttccatttctcttaagaagacatgaatacattagtacagtaacatatttatctctacttccttgaaattttattgagaaatccatcattttccaaacttttctttctattggtgtaaaatagggatgaatggccatgagcacttcattgcctcatctcaggtgacacttttttgccctttgaaaagcctataatgtactttataatgtagtttaacttttccacttcacctcatgtaaacaaactgattttccaacttatcaatacagtatgaacatttctccaagtcaattaacaaaaagaggaaatatcactttaaatgaatgcacagtttctctatatagagaaaaataatatgtgtgcatatatgcatgtgtaaatatatgtatatgactaaattctacaagtttttaaactatctttttactgatggagactcatcatgatttttttccccctgtactacaaacaaagtagccataaacattctaacattctggagtatggtatcccttatatgaaatgcttgggaccaaaaatattgtagattttggattttttcaaattttgaaatattttcatatcataacatgatatgttaagaatgagacccaatctaaatttatttacattccctacatatagtatacatgtagcctgaaggtaattttatgtatttgtaaaattttgtgcaagaaacaaaattttgactgtcttttggctgtgaccagtcatataatgtcatatgtgaaatttttcacctgtggcatcatatcagtgctcaaaatgtttccaattttgaagcatttcagatttcagattttttagttgaccttggaacaacatgggtttcaactgtgcaggtccgcctacactggtatttttttaaaaaaataaatatatcagaaaaagttttggagaattgcaattgaaaaaactagcagactaactgcatagcctagaatataagaaaaaaattaagaaaaagctatgtacatcctgaatgcataaagtatatgtatatgttaatctattttatcatttactaccataaaatatacacaaatctattataaaaagttaaaacttatcaaaatgtatgcacacaaaccgtacaagtcactatttgcagtcaagagaaacataaacaaacataaagatgctgtattaaaccacaactgcatacaattaactatagcacatactgtactacccaaataattacttttattttatttttataaatgtgctaggtacaagcatacttttattatatgattgttttgttatttggatatattgctagtggtgaagtctgagcttttactgtactcatcaccccaatagtgaacattgtacccaataataatttttcaaccctcactcccctccaaccctggcatgttttggaatattctccagcgtctactttccagtgtatgtactattataataattttgtagccaccccctgttgctactgtggtgagctcatgttgccagtatctgccatgagcacttggtctcttcagtaaattctgtatctaagtaaatagtgtgttctttcacagttctcttttcattgtgcttagtgtaatactataaatcttgaataacaccatgagaccaatacaaagtgccacaagtgatgctgggagtgctcccaagaagcagagaaaagttgtgacattatgagaaaaagttagattgcttcctatagattgagttcttcagctgcctgccatttcaaaataaatgaatccagtgtaaggtcccttaaaaaaaaaaaagagaaattcataaggcctcatttcgtgccaacaggcatgaaaaccttgtcctttcttatctcatattcaaaatgcagcttttatgtggggtacagaattgctataagaaagacatacctatagactcttatttgattcaagaaatagcgaagtcattatttgacaacttaaagtaaaagcaaggtgaaagatctaaagctggagaatttaatggcagcaaaggatgatttgataattttagaaagtggtttggttttaaaaatgtcaggataatgggagtagcaacttctgccaaccaagaaccagcaagtgaattctcaaatgccgttaagaaaaacattgaggagaaaggatatctgcctgaataggtattaatgcagctgaaagtgccctattccagggggaaaaataaaagccacaaaggtcatttattagtaaggaagagaagcaagcaccaagatttaaggcaggaagggataggctaactctactgctttgtgcaaatgtagtcgggtttatgatcagggctgcccttaactataaagctgctaacccctgagtcttgaaagggaaaagagaaacactagttgccagtcttttggttgtacaacaagaaggcgtggactatgagaatgctttttctggattagttccatcagtgctttgtccctgaagtcagaagtaccttgccagtaagggactgctttttaaagttttttgttgttgttgtttaattggaaaatgccccctggccacccagaaccccatgagttcaacaccaaaggcactgaagtgttctccttttcccccaaacacatctctacttcagcctctagataagggagtcataaggacctttaaggctctacatatggcactctatggaaaggtttgtcaacattgcaaaagagaaacccaatacagagaacatcatggaagtctggaaggcttacacctttcaagatgtcatcagttgatatagaaaaccatgaaactcaaaacaataaattcctgctggacaaaagtacaatttgtgtccagatgttgtgcatagctacagaattacgacaaacccaatttagagaaaaccatggaaagaagtatggatatgaagggaaaaaaaggtgtggagtgaagggttgcaagatatggatcttggaggaatttaagagctaatacacaccacaccagaggaattaacaaaagatgacttcatggagatgagtgcttcctaaccagtgccagataatgaggaagaagacataggaaaagcagtgccagaaaacaaattggcattcaacaatctggcaaaagagctttgattattcaagactacttttgacttcttttatgacatagaccgttccatgatacaggaactgaaactaaagcaaatggtggaagacggataggtactacactgaaatgtttttagagaaatgaaaaagcaaaatagacagaaataatgatgtatttttgtaaagtttcaccaagtgtgcttgcctcttttgcttccccttccatcccttcaccctcttccacctctgctaccctaagacacaaagaccagctcctcctcctcctcctctgcctactcaacatgaagacaacaatgatgaagacctttaggatgatccacttccacttaatgaatgggtcatatattttctcttccttacaattttcttgattataatttcttttctgtagcttagtttattgtaagaatacagtatataatacacatagcatgcaaaatatgtcttaaatgtaacgcatgttatcagtaagccttctggtcaacaataggttattagtttggggggaatcaaaagttgtatgcggatttttcactgtgtgggaggccagctcccctaaccctatgttgttcaaggggcaacaatattctttctcactggcactttactttccataaattcaaatcccaaaagtagaactgcaagttcaaaaggatttttaaaaaaataattactgtcagattacagaaagtttccaatttacattttcactaccaatgtacaatgttggcgtccctgaatccttatcagcaatgaatttttaaatatactataagagatgaaaaaaatttttttaaatttggaattccctgatcactaatgaagttaagcatcaatattattcctttaatatgcaaatgctgaaaatacatttaactataatagatgtcaaaaatctgtaaatcaggctaggtgtggtaggcactcacctgtattcccagccactgggagacttgagtccaggagttccagactgtagtatgcaatgatcaagcctgtgaatagccactgcactccagcatggacaacatagcaagaccccatctttttttttaaaaaagagtctataagacaaaggtcctcataaattaagagaagccaagacagtcactgtgactgcagaatattttaatttttttttattatattttaagttctagggtacatgtgcacaacgtgcaggtttgttacatatgtatacatgtgccatgttggtgtgctgcacccattaactcatcttttacattaggtatatctcctaatgctatccctccccccagccccccaccacagagcaggccacagtgtgtgatgttccctttcctgtatccatgtgttctcattgttcaattcccacctgtgagtgagaacatgcggtgtttggttttttgtccttgtgatagtttgccgagaatgatggtttccagcttcatccatgtccctacaaaggacatgaactcatccttttttatggctgcatagtattccatggtgtatatgtgccacattttcttaatccagtctatcactgatggacatttaggttggttccaagtctttgctattgtgaatagtgccgcaataaacatacgtgtgcgtgtgtctttatagcagcatgatttataatcctttgggtatatacccagtaatgggatggctaggtcaaatggtatttctagttctagatccttgaggaatcaccacactgtcttccacaatgatttaaccagtttacagtcccaccaacagtgtgaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtctgttggctgcataaatgtcttcttttgagaagtgtctgttcatatacttctcccacttgttgttggggttgtttgttttttcttgtaaatttgtttgagttcattgtagattctggatattagccctttgtcagatgagtagattgcaaaaatgttctcccattctgtaggctgcctgttcactctgatggcagtttcttttgctgtgtaggagctctttagtttaattagatcccatttgtcaattttggcttttattgccattgctttcagtgttttagacatgaagtccttgccatgcctgtgtcctgaatggtattgcctaggttttcttctagggtttttatggttttaggtctaacatgtaagtctttaatccatcttgaattaatttttgtaaaaggtgtaaggaagggacccagtttcagctctctacatatggctagccagttttcccagcaccatttattaaataaggaatcctttccccatttcttgcttttgtcaggtttgtcaaagatcagatggttgtagatgtgtggtgttatttctgagggctctgttctgttccattggtctatatctctgttttggtacaagtaccatgctgttttggttactgtagcctcgtagtctagtttgaagtcaggtagcgtgatgcctccagctttgttcttttcgcttaggattgacttggcaatgcgggctcttttttgtttccgtatgaactttaaagtagtttttttccaattctgtaaagaaagtcattggtagcttgatggggatggcattgaatctataaattaccttgggcagtatggccattttcacgatattgattcttcctatccatgagcatggaatgttcttccatttgtttgtgtcctcttttatttccttgagcagtggtttgtagttctccttgaataggtccttcacatcccttgtaagttgggttcctaggtattatttcaaatattattgtaaaacaatgagatattgaaacatacattggagcaaactcttcttcattcttaaatcctttcagcacagagacaatcaactgactgtctgggtactacctgaccactattggagtctctttcatctgcctgagtctgtgcaacaatatgaaattataattttactatgcacctaaactttcctcaatatattgaattcttacagaatttgaagagtcaaattttgtaaatccagttacctttttccactactctaggcctcatatactatctggcctaagggttaaaggtccacaattgaataagccaaacttgttaatttgagggtaaagcatgtcaagaaatctggccttaatgtccaatgaacttatgtcatattaagtagctggatagaaacatgcattccaaagtggatactgtttatcaggctcagtgctctattcttgacagtaaatcccagaatagggtggatgctttaattttgtattaaatagtattaggtgtaatatcaaaaccactaagggaacactaatgatgagaataggaacactagctgtggagctggcaattttctatagaaatcctatctctttcaattgcctgtttagtgggcaagtgtttcagttcctataatatctaaattggagaaaatcaccccacctacttcttcaggtgttatgataattatgagggataacatctttttaagtgtttaacacaattcctcacacatagaaagcaataataaacattggctagcattgtaaggatggattattgtctttcaatgtgttttcatacattttctttctgggatcttgagtgaaacatgtggatctataacaagaacaaaatgatgttaccttgatgatctctatgtagggtcacactaaaggcatcttaaaatattttgctggccaacaaaagacacctcctgttctaattgggcattgtccttttctttaaactatgcagacaaacaatattataaagtgagaacatccacataaaaaacctaaacataaatcttaatagtgagttcatgaaaattcttactgatgaaatggcaatgtcacagactgactgtttatgtccccccaaatttgtatattgaaatcctaacccccaaactactcgtgttaggagatagagccttggggaggtgattaggtcatgaggacaagattctcatgaatgggatttgtgcccttataaaagagatcccagagagctcattggccccttccaaagtatggggatacagcaggaagttgccatctatgagccagaagggtgaacctcaccccagatgctgaatctgccttgatattggacttcccagcctgcacaactgtaagaaatttctgttgtttataagttactcagcttgtggtattttgttacagcagcctacacagactaagacaagtagcattttgaggattaaaatttcttcataaatgaatagagtatgccctgttaaaccatattctcagctaaccccatttactcactgttcctctttattttagtttcacatttttgctatttatctctgtaatttcattcaatcttcacaatttgccattcttatacttcgaatcatgttatcagtttataatacctccatcaaatgatagtctgcatttgtttatccttggctgattcaaaacacttggcataatttccttaaaggaaatcatcttcatctcacctcacaacactgtattattttcaattaatttccaataaactcttaattgtccatgctctgtcagagttggcagagttaatccctgtttaagctaataggttcaacttcttcaacaaacaaatctggctgctgacaagccagagtattaattaaatctagtttcattgcttctcactttccttgatctttctctcttgttctttgggaaacagtcacagagttctggcgctaataaatactataaaaagtaggaaatacagtctaaagaagcagaatattctgtttaaagttgatgtggtgctttttgtgcaccaagcattggctcaaaagcctgaaaattaggcagcaatacttcctaagctcatcttcaaccataaggcagaaaagccaaacatatctgaaaatataatatcactggtaccttataccagcactaagaataagaaaaccctggaaagtggctcaagtacaatatttttctattggaattaatttttcaaaatggaaaggacttcattgttatttttattataaaattagtatatgtttattattaaaaataagtacaaaaatctctaaaagaaaaagggaaaaattaccagcagttccacattccagatatcatcactgttagcatttaggatacaaatatccaaacactttttctatcaatacatttaatttttaaatttgaccattacgcaatgtacacatgcactaaagcaccacactgtaccccataaacatgtgcaattattatgtcaattaaaaacaaaataaaagcattttacaaaaaatcatgttatttttaataacttgtttttctaattttatacaccataaaataaatgtctttacatgacatttattttatgataataactaatttactcatttaaacagcaaggtacatttcattctacagatatactatataatatttactctgatctctggatgagaatttatgttgcctgtaaatattgtatcacaaacattataagaataatctctgtaaaggtttttttcctgtattattatttgggtagaaaaattactagaaatagaataactgggtcaaagattaaagacaatttaaatttcaatatatagaatcaaattattctccaaaatattgtactctacagtatttgaattttgatttttttctccattttcactactgccaataactttaatctttgtcgataaatgagacaaaaaagacgaataatgcaatattatacaagggagattaataggtagaaaaagaaatgtaatggccaggagtaacagaagatgttcaacatcaatccaatcaaattagtctttaaaatgcaatagcagtcaatgttagcaagagtgtaggtattagacattctcataggaatataaactagggccatgttttaggatcatattagatcgcagcaattaaaaaatgttaaattcatatgttctatagcaacttttcaggttggaatttatcacatggagaatcttgtaaaatacataaaccaagatatgttattaatgttattggtagcctattgtttaaataaaaaatatatttatacaatacagttgttaaaagttaagaatatcttgaaggtaaattattaaacaaaaatagaaagcctaggccaggcaagacttcatgtcatgcttgtaatcccaacacttttggagactgaggctggaggattgcttgagcccaggagtttgagaccaacctgggtaacacagtgagacctcatctctagaaaaaaaaaaatacaaagcttagttctgaacatccttttgtgtaatactaaaagataaaattttattttctaacttgtttaagatctatattctatacgggggatgtgtattaaggtcatttttaaaaaggtactcaagaaattgtcaacagtgattatcttaaggagagattctagatgtctgggggtaagagactagaggaaagagaattttatatttcatttttacctttatttaattttttgattttcttactgggtgcatgaattatatttttatgtcagcatgttttatcagataaataaaattatgagctatttctgttttctctcatttgttttatgtttaaataaaggaaaatgagatatgtctttttaaattagataatcttgagtccatgattattatgaaagccctctgttatctttttccttcctttcacaatgactatttatgttgtagaatcattaatttctcaagacaaatgtcttagaaggtagatacaaaaaaaggtatacattttttgattcaagctaatttcatgttatgaacaaaattacgtaatgtcatttctaagacctttctgtgatctatcaatccactaggttaaagagcagaaatcacttccaaaacaaatccttttgcagtcagcaaaatgaagcaattatatgaataagtttttccacttggcctatttttctacccagggttattaatcagtctcattgactacattttccgttttacatcccctttcaggcactactgcagatggccaagcatatcacattatgtaaataaaataaaacaaaatcttctcccattgagcaaatggatatacttcacctctaatgcttccagtctttctcagatcattcaaaaagcatgatatggtttccataaaaggacattcatcccatttgactaactggaatttctttactccagctaatctttaccaaagagctgaattaattcaagttgacaccctgttatctaccagctcttccagcccttttgcttgattgttttgtcattttgtcttttcttttcttctaaagtgggagtatggagatttacccttctgaaacagctgtgtcacatcatgatccttgaggatatcagctcttaactggctgcacatcaaaatcactgtttcctttgaccaatactctagacacactcaagcagagattctggattctgatttaattgacacagagtagggcctgggcatttttacagctccccacatgattctattgtgcctcatctatcctagcccttaagcaggaccaaacatttgttctatcttaattattattctcttaaacttagtccaattccttacaactgatagctttctatatactcatctgccttgagtgatgacaattgatatggtttggctgtgtccacacccaatctcatcttgtagctcccataattcccacatgttgtgggaggtgcccagtgggagataactgaatcatgaggatgggtctttcctgtgctgttcttgtgttagtgagtaagtctcatgagatctgatcatttttaaaatgggagtttccctgcacaagctgtctctttgcctgctgctatccatgtaagatgtgacttgctcctctttgtcctccaccatgattttgaggcctccccacccatgtggaactgtaagtccattaaacctctttcttttgtaaattgcccggtctcaggtatgtccttatcagcagcatgaaaacagatgaatacaacaatactgtaacaaattgactcacatctgttctctttataggaattgcaatgctacaatattagtggctcttaattctaagagtgttaaaaaatattaatgcttgtctcacccctaaagtctagggtgtgacctgagtattaggttatttaaaacttttctcaggtaatagacatgtgcagccaaggttgagaaccactctatagggccaagatatgtaagaaaattcaagtcctttagctgggcgtggtggcacacagctgtagccccaggtactctggaagctgaggtgggaggattgcttgagcccaggagagagaggctgcattaagctatgatcacatcactgcactctagcctgggtgacaaagtgagatcatgtcaaaaaaaataaaaagaaaggagaaagaaaggaagaagaggaaggaaggaaggaaggaaaagaagaaagaaagaaaggaacaaagaaagaaagaaagaaagaagagaaaaagagagagaggaagaaagaaagagagaaagaaagaaaagaaaaaggaaggaaggaaaggaagaaagaaagaaaaagagagaaagaagaaagaagaaaaggaaagaaagaaaggaagaaagagagaaagaaggaaaagaaagaaaattcaagtcctgccttgtaaaatgcagtactccattttcccaaagagatcccaagggaaacttaactacaggataaagacaaacaaaaggacataaattacaactactctaggttcacatattattttgtttctgaaattggttttaaaatatctatgtcagagttcatttctagaactttatctctagaaaacatattttcacttctcaatacaggaaaatggagactggaaaaatgaggttggaaaatgatttccatgcttatctctcagcttcttttttcaacttccctttttcatctccgtatcttcactgatacctaggaatctctgttacatcacagtcttcaagagctttgcttgcagcaaattagttaagacattagctttcaaaagtatatgatattctctcacaagcatttgtctacttttaatagggcaagctacgtaaagatgttaaatctcattccagaaataccacatctactctacctatttatgagaacagtcgtctctagaccaagatagacattcatagttaggaaataaatccctgtaggctttttccacagtcccaatatgtcccctactgtcccgattttagcaacaaaaatcccccatccagaaaatccttcattcctgagtaagttgaaagattggtcaccctatttctatctgtgtctctttctttcataattggctcataatcatagcagtcacaattttgaaaaattttattttactgaattactcattgctgttttctcattttttaaataataaacacttattaagaaacattggaaatataccgaaaatagtaaacaataaaacagaaaccattggcagaaatagtcactattaaaatcttaatatactcccttccaatgttgtttctgttaatgcaaattaaaaaatcagagattcgcctctgtgaactagatctttttacctttagatattatttgacaaatatatagctcgatcatctatccaaacttctcttttacagactccatgccaattaaccttctcctatgaaactattatttcttcacataggataaatatggtttttgacacacaaactttcttagttacactgcaatccagttgtgcatctctaaatttataccaattggatttagaatgatcattactaaagaggcttggtcttatctcttgcaatttgcttcttccttcttaaattcaattcttgtaatgtaactataatttgggggtattttttgcctcatattcaaattctctttcaaactgaggtacatttctgtatttctgtatttgtatattgtatataatagtatagaaaacaataatgagattatagtgtacataaaagttttgaattataattaaatatttaatatataaatatattaaatatgtataaaatatctgattagtaataagataataatttaaaacctctgagttttaaaactaggactttgaaataccagcaaaggccacctgctttgaccaacatctcttttccctgcctgctttaatcatgtcttgggtcctgacaaatttgcccccagatccctcccaaattactctccaactctgttctatgtttcaggaaaataacatttatttcccagtctcctttgccctccattttcccagtaggctatccagtgagagatgccataaaagcctgcctcttctctgcagggctgcttcccaccagatagcccctccctccatggacccaattcccattagctctagcaacctgcctgaagtcctggccccttggctctgataataacaccttcttccatgatccttctagtcctaggggcagtactggtttcttgctcttgagctgctgactcaccaagcctggtttggcttccatcacttgtgtaatcaatcacctgtattaaatcacctctgcttgaaagacgaagaatagtttctgatttataagcaaacactgaaagctcttctatttcttgtttgctaaacaagatttgtcaaagttaaatattttattttattgaattcactttttgcctcttctacaatgatgatttgcttttcctcctttaacttgttaatgtgatgaattatacatagttttttttctattgttagaaatccttgcattcatggaacaaacacaattttcatactatattatcttttttacagatttctaaacttaatttgctaacttttaatttaaaatgtttgccgttaggttcatgaggaaagttggcatgtaattttcctgtcttacacatttctcatataacattggtatcaaggttgtactggcctcataaaatgaacaaacaaatggacctttttttattctggagttgtttttataaaatggaaataatcaatttcttgaaaacatttgatagaactcaccagtaaaaatgtctgggcctgctggttctcttcttctaagaagaatttggaacttataattaaagctcctttaatgtgttagaaaactttccaggtttccttgaacattaataaattccaatgatgaaaagccctcagatattaaatataaccttaaatataaccttcccccaattcaatttttcttttgcagatatgattagatactctaatttttcaacctctatttcacctatccattttcctttcctcctctgtactgtcttcagcataatttgtttagtctaacttccaactcacttattttctttttggttctatccaatattgtgtttaacctgtccatttagtttttaattttcattatattttttatttctaaaagatctcttaagttcagtttcaatctgcttaacataagatacatacactgtctcaatttatattcctggcacacctcattgattttttaaacctattaaacacagcttttatagttatataatcatcctaatatctgaaatctttatgggcataattctgtttctgctcatgatgtttatttcctcatgagttttgtaagagtcttacttttttctcattttggatgaaattttacctgtggccattctttgagacatgggctgaatgtgggtttctccaaagacactttgccttcgtcttgtgtttggtggtaataccaacatgggataactataaaataaattatcagtttcatgtgtgggtttttttaaaattatacttacagtgaaaatttaaaccacaaattcatgtgaagatggccttctaatttttcctctaaatagcaccgagtttgaggcaggaaaatttcctggttgtctccccctgaggaacaggtttttatctagtttatcctttcactgaaattatagtccttcatatctctggctttcagcagttttctcctgtaagactgctatactgggcaggcactaggttttgtctcacactctcccatatcccaggtggtcataaaaattgaagctcagggtactagggccaggactgtccttatggaagcttctggtttgggggtctgcatacctctctggatttatgtattctccttatgcttggcctatgtggttcaccttaatttctattcaagtcagtaatatacttttgaaaaatgacatgtacattttatctggtatttgtagatttcatatagcaggatagtgattcaacaaatttagtctgtcacaatgctaggaatagaattcccctaatttttgaaaaaattatatcaaatcatgtttattgccattaatagtcttataaatgtgcttttaagtaactgcattttgtcatagctcattgtgattgtatatttaactaattcacccctacctcatgttttttgggagtgaaggttgtactcaactcattatgttaagtaatactacagtaaacatcaatctatacatgcattaataatgatttccaagaaagtagtgacacatggtcataatcatctttgaggctgatggtacatattttcaaattgcatctcagaaataatataccaatctgtgctctaatcagccgcatatgaaagtgtcatctttctgttctccaaccaatacaactactactgtttttatacctacaaatctgacaaagatgggagaaggtatcttatagtttcaatttgtatttctttggtgaccaatgtactaaattactcaatgtactaaattactcttttcctgtttatcatccatttcaaacaagatgtaaaccattttaaatttttttatattaatgcaaatcgtaaatcactactttatttattcaatttcctaagcaaaattatatgttgtcccatttatacattttatattagatcattctgccttacatttatatcctaaaaactgtcagaattatataataattatgaacagttgattataaataatgcctttattaggatatttctccataaatctaaatttcatcaatctttctttaaatatctctacacaatttcctcttgtattatattaataattgcagatacacttctttttgctatttctattaattctttcctattcctattgtctgttagtctcccattttctcccataaaataaataaaaatttttctatcagattctgtgatatattacttcttattcccagccttcaacattttaagaattcagattgaccttttctcccattcttatttcaagttatcagcatgtcaatacttgggaaatcccatcaagtgtttaacagtgcataccttactgattcattatttatttcaatttaatctttcttattttcattcaacttttttctcagtaatacaactttttcaagctttttattttctaatgcatttctccaaatagcagccataacccttatatgccctctttcaatgacaacaacaaaagtgtgctaggcttcttggaagaaaataattataccaatttaagaaggagaaaattgatgtactgataaacaaatgggcatcttaggatcatgtttctcacaagtaaggcagttccagaaattcctaggaccctaatgggttttattctaaataggttaaacatatcacttaaaaaattgttttctacagttctctaatattgcttacaattgtccacgtttccatgtttataaacttgcacttttttttttatggagttttgctgttgttgcccaggctggagcccaggctggagtgtagtggcgtgatcttggctcactgctacctccacctcccaggttcaagcaattcttctgcctcagccttctgagtagctgggattacaggtgcgtgccaccacacctggctaattttttgtatttttagtagagacggggtttcaccatgttggccaggctggtctcgaactcctgacctcaggtgatccacccgccttggcctcccaaagtgctgggcttacaggcatgagccactgctcctggccttatacttgcacactttttaattctaagaccttgctactcagtgagggatcctgggactaataccatcagcttgacttgaggccctctttgaaagcagactcagaatctgtaatttatcaggatccccaggtaatttgtatgtgcagtctagtttggtagatctgctctggcagactggaagactcttctatctgcctcacgtaaggtgcaggtgacataattaggtaatcaagcaaaagatcacatattttaataagaaagagacactggctattattttgagtggcaaaacaggttattcagtcccagtttaaaatggaaatgacagagaccaagatcaagatttttaatttgagatgtgcctgcgatgcaattacatttgctgaatgaaactgcttcagtaattagatgcaggtttcttctctcttctttttgagatgtaaagaagacacaatagactcatggaacttaaagaactagacaccagctaacaaaacatgctatccagactcttccatttcaccatattgctttcttgaaaacataggacagtgccagtttagcactgaaaaaaatcagttctcctaattctaaaaagaggagacagccaggcgtggtgggtcactaaacatacaaaaaattagcgggcatggtggtgcatgcctgtaatcccagctacttgggaggctgaggcaaaagaatcacttaaacccgggaggtgaaggttgcagtgtgctgagatagcgcctttgcactctcgcctgggcaacaagagcaaaactccatctcaagaaaaaaaaaaaagaaagagagagagagaaactgtaatttcatttcagaagttttatagggtactatttccaattctttttttcttactccattaaagtgtaattagcagtatgtgaaaatttccactttatcctcaatcagaagcctctccttccaattagcatattttttttctattaactttgtaaagtgggattcttgttttatacatacccctggaaagtatacttaaactgtgagaccctgggattttatatttccaaatagaagataccatcctcttgtatcacaaaatgtatctaagatggtttggattatatttaaatattcttgaatgaaatagacttactgactgaagccaattattagatttttccacaccaaaataaatgcaataggaaaagatgacagttctatgtagtattcctgcttccatattgcacaaattagaaacatacatattctattatgttacagggtctagggctttgggaggacaaggctgcaggcagccgagattgtgccactgcactccagcctgggcgacagagtgagaccttttctcaataataataataaaagtaaaaagaaatataatatttaatcaatatatgcacacacatgggtttatcatgacacacatgacatgtgtgtacagtgaaaacaatgagtaaatctagaaacctgtattgcctcaatagctagctaagtacttcaatatgcatgtttatttcaacaattttgtgttaagctttagtggtaaataagcagagtacactggccataatgaatactccttttgatgagggttatcactacacaattaaaatattacatagttggctgggcacgttggctcacacctataatcccagcactttgggaggccgaggcaggcagatcacctgaggatgggagttcaataccagactgactaacatggagaaaccccttctctattaaaaatacaaaattaaccaggcgtggtggcacatgtctgtaatcccagctactcaggacgctgaggcaggagaatcacttgaacctgggaggcagaggttgtggtgagccgagatagcaccattgcactccagcctgggcaacaaaagcaaaactccgtctcaaaaaaatatataataataaacagatatatattatatatataataaatataaatataatatataatatatattatatatataataaatatataatatatattatatatataataaatatataatatatattatatatataataaatatataatatatattatacatataataaatatataatatataatacatataatatatatattatatataataaatatatcatatagatgatatagtttagagttaaatactgactgctcttgggaactttgaggtattctgagggatataaataacacgaagagaatagcacattggcttgaagcagattagagtctgctacctgcgtgaatacttgcttttcatgaactatgaggatgcccttagcttttgaaccacttctacttgtgttgaaatttaccctttaattttggggtttgacaggctctgcccttctgttatgcttgagtctggcttttcctactctgactcactttgattcttgacctctgaatcttattcctattttacaataaacacacatcgcacatacgccaattagtagagtggaagagggaaaaattgccaaggaactatgtttaattttgttcctttcgcaaaccagacaccataacagaaaaattttaggaacatgtgcatgttcagtagccttcaatgcaattatactggttattaaaaagtgttggataatcaatattttttaaagattcactagtcccttctcataattttagaactttgggaagtaataatacaaatgtatttttagctgtgtcctttaatcttttactgtttcctctatgtgtggtgtttggtttgtgtgtgtgtgataattattataaagatcagaggctaacagaggtgttaatcacgaacttttaaatttttttatttttatttttttattttttttaagagacagagtctcgcggtgttgccaaggctggatgcagtggcgccaactcagctcactgcaacctccgccttcagggttcaagcgattctgctgcctcagcctcccaagtagctgggactgcaggagggcaccacgatgccccactaatttttgtatttttagtagagatgcggtttcaccatattggccaggctggtcttgaactcctgacctcatgatccgcctacctcagcttccctaagtgctgggattacaggcgtgagccaccgcgtctggctgcatgaccttttaacttgtctcatacactcaatattctcaagatataccttccaaagtgaaaaattatggcactttgcagccctgtccactaactgagaactttgatgctttggattttggagacctcattttatcacctggtccttttacttcatgacttgtcatgctgccaccttttgatgggattgagatcaagataataattcccaactggtcaggaatattgtgcccctttgtttttatatccagatgcaatagagcctctgacacaccactactattgttcttaggatttggaacaaaatgcttctttctttgacaaaataaatgttttctttaaagaactcttgattgatcctggaccattgtagaaactgaagtcctatcaatgcaaaaaaatatgacaacatgagctgcttatcatgaaataagtgttttccaattaactatcctgcttcatcagcaggtaggaataatagaatctatacctatgtcttcatgggaagttctctatggccagttgattagtgagggaaaaattgagcctgatttacagaagtcactgtacaacatcacagcaacagccaaaagtagattgcttaggcattataacctacgtgaatgcaattttaaaagaaattcagcctatgtaattggttgtccacgatgtctagaaggagagatattattgatgtatatgtggcagctaataatttgtctagataattagggacttggggccaggcctgatggttcacacctgtaatcccagaacttttggaggacaggacaggtggattgtctgaggtcaggagttcgaaaccagcctggctgacatggtgaaactccgtctctactaaaaatacaaaaattagccagatgtggtggtgtgtgcctgcaatcctagctacttgggaggctgaggcaggagaatctcttgaatccaggaggaagaagttgcagtgaaccaagattgcaccactgcactccagcctgggcaacaaagtgaaactctgtctcaaaaaaaaaaaaaaaaaagaaaagaaaagaaaagataattagggactcagaaagacaaacactgaaggattggtggcaatgagttttggggaaaaaatatgtagatgaaccacagaaaatgagccagagtgtaagaatatttgtgcttaatacaaatgctcaccaaactatcatcaggaaggttatcaaatagatatgaaggtatgaaacaatctctttcaccaggcactacattgcttgctcagaaggctaataaacagcaacattggtggtagcagtagagaatacacataggtttagcaacatgttggactttaccactctcgcttacaaaagcctatttagctgtcaagactattaggtgtccaacacacaagcaacaaagtccaaggctaagcacacaataacatatcctgggtgaataaaccagtcaccttttgtcagacttgttgattttactggagctcctctatgataaaggcaacaaggaattttgtaaatggaatctacctttatccttgaattacatttgctttacctgacatcatttttctctgatcgccactctccatgggtacattgaatgccttatatatactgccataatatcctgttctacatccttctattaaaagaacttgttgtataacaaatgagtagatattcattggactcacctggtccaccatttatcctatcaccaaccaaaattattattattatagaatggtgaatattttattaaagactcaatcacagtgccagctggagacaatggcttataaggttgtactcatgctagacgatgtggtggtgtatcctctgaactagtaactaagtataagcttgtctggtgtctcccatataaaaaatacaacaatctttgatatttgttatgaacgttgaagtgactccttttgtcattacatctaatgatccactccaaatacttgtctcttgtctctgagattctaggtttttgcagaattagtacccaaagggagagtcttagcagtattccattttacaatccatccttcgttagaggatgagagacttctatctagccttttaggttgcctgagacctttaaacaaactgtcaaaaatttaaaatttaaaatgcggctacattgttgcatggggtagtaaatcttgaccttaaaactggtatttgtaagaaaaacagaaagaattcagggatcccctttgatggctcctaattctatacagtcctgtaaatattcctgaagactaaccaggcgtagtggtgcacacctataatcccagctactccagaggctgaggaagagaatcacttgaacctgggaggcagaggttgcaatgagctgagattgtgccacttcactccagcctgggtgacagagcaagactctgtctcaaaaaaaaaaaaaaaaaaagaagaaagaaagaaagaaagaaagaaagaaagaaagaaagaaagaaagaaattaatgaagactgccacaacttggaagcaaccaaggtatccttcaataggtgactgcataagcaaactgtggtatattcctacagtggaatattattcagtgctaaaaggaaaaaactatcaagccacaaaaagatacagaaaaaacaaagacattttgctaagtgaaagaagccagtctgaaaagggtacatactgtgatttcaactatacgacattctggaaaaggacaaactataaagacagtaaaaagatcagtggttatctttgcagacgccaccatcactgtgagccctgtactatcagccatggtcaactccgtcgtcttttttgacatcaccgtcgacggcaagcccttgggccgcatctccatcaaactgtttgcagacaagattctaaagacagcggaaaactttcgtgctctgagcactggagagaaaggatttcgttataagggttcctgctttcacagaattattccagggtttatgtgtcagggtggtgacttcacacgccataatggcactggtgacaagtccatctatggggagaaatttgatgatgagaacctcatccgaaagcatacaggttctggcatcttgtccatggcaaatgctggacccaacacaaatggttcccagtttttcatctgtgctgccaagactgagtggttggatggcaagcatgtggcctttggcaaggtgaaagaacgtgtgaatattgtggaagccatggagcactttgggtacaggaatagcaagaccagcaagaagatcaccattgctgactgtggacaattctaatgagtttgacttgtgttttattttcaccaccagacccattccttctgtagctcaggagagcacccctccaccacatttgcttgcaatatc
